US012551573B2

(12) United States Patent
Fernandes et al.

(10) Patent No.: US 12,551,573 B2
(45) **Date of Patent: *Feb. 17, 2026**

(54) COMPOSITIONS AND METHODS FOR THE TARGETING OF PCSK9

(71) Applicant: Scribe Therapeutics Inc., Alameda, CA (US)

(72) Inventors: Jason Fernandes, Redwood City, CA (US); Sean Higgins, Alameda, CA (US); Sarah Denny, San Francisco, CA (US); Ross White, Concord, CA (US); Emeric Jean Marius Charles, Berkeley, CA (US); Addison Wright, El Cerrito, CA (US); Benjamin Demaree, Berkeley, CA (US); Benjamin Oakes, El Cerrito, CA (US)

(73) Assignee: Scribe Therapeutics Inc., Alameda, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/516,840

(22) Filed: Nov. 21, 2023

(65) Prior Publication Data

US 2024/0123089 A1 Apr. 18, 2024

Related U.S. Application Data

(63) Continuation of application No. PCT/US2023/067987, filed on Jun. 6, 2023.

(60) Provisional application No. 63/505,823, filed on Jun. 2, 2023, provisional application No. 63/492,923, filed on Mar. 29, 2023, provisional application No. 63/349,981, filed on Jun. 7, 2022.

(51) Int. Cl.

| | |
|---|---|
| ***A61K 48/00*** | (2006.01) |
| ***C07K 14/47*** | (2006.01) |
| ***C12N 9/10*** | (2006.01) |
| ***C12N 9/22*** | (2006.01) |
| ***C12N 15/113*** | (2010.01) |
| ***C12N 15/88*** | (2006.01) |
| ***C12N 15/90*** | (2006.01) |

(52) U.S. Cl.

CPC ........ *A61K 48/005* (2013.01); *C07K 14/4703* (2013.01); *C12N 9/1007* (2013.01); *C12N 9/22* (2013.01); *C12N 15/113* (2013.01); *C12N 15/1137* (2013.01); *C12N 15/88* (2013.01); *C12N 15/907* (2013.01); *C12Y 201/01037* (2013.01); *C07K 2319/09* (2013.01); *C07K 2319/80* (2013.01); *C07K 2319/81* (2013.01); *C12N 2310/20* (2017.05); *C12N 2310/531* (2013.01)

(58) Field of Classification Search

CPC .... C12N 9/1007; C12N 9/22; C12N 2310/20; A61K 48/005; C07K 14/4703

See application file for complete search history.

(56) References Cited

U.S. PATENT DOCUMENTS

| | | | |
|---|---|---|---|
| 5,173,414 | A | 12/1992 | Lebkowski et al. |
| 5,208,036 | A | 5/1993 | Eppstein et al. |
| 5,264,618 | A | 11/1993 | Felgner et al. |
| 5,279,833 | A | 1/1994 | Rose |
| 5,283,185 | A | 2/1994 | Epand et al. |
| 5,405,783 | A | 4/1995 | Pirrung et al. |
| 5,412,087 | A | 5/1995 | Mcgall et al. |
| 5,445,934 | A | 8/1995 | Fodor et al. |
| 5,695,937 | A | 12/1997 | Kinzler et al. |
| 5,753,613 | A | 5/1998 | Ansell et al. |
| 5,785,992 | A | 7/1998 | Ansell et al. |
| 7,368,551 | B2 | 5/2008 | Li et al. |
| 8,278,036 | B2 | 10/2012 | Kariko et al. |
| 8,450,107 | B1 | 5/2013 | Zhang et al. |
| 9,738,593 | B2 | 8/2017 | Ansell et al. |
| 10,106,490 | B2 | 10/2018 | Du |
| 10,166,298 | B2 | 1/2019 | Ansell et al. |
| 10,221,127 | B2 | 3/2019 | Du et al. |
| 10,570,415 | B2 | 2/2020 | Doudna et al. |
| 10,577,630 | B2 | 3/2020 | Zhang et al. |
| 10,851,370 | B1 | 12/2020 | Wu et al. |
| 10,927,383 | B2 | 2/2021 | Aneja et al. |
| 10,960,085 | B2 | 3/2021 | Conway et al. |
| 11,072,782 | B2 | 7/2021 | Cathomen et al. |
| 11,219,634 | B2 | 1/2022 | Prieve et al. |
| 11,384,353 | B2 | 7/2022 | Chen et al. |
| 11,434,491 | B2 | 9/2022 | Chen et al. |

(Continued)

FOREIGN PATENT DOCUMENTS

| | | | |
|---|---|---|---|
| CN | 114015674 | A | 2/2022 |
| EP | 3 209 783 | B1 | 11/2021 |

(Continued)

OTHER PUBLICATIONS

US 12,018,249 B2, 06/2024, Vijayakumar et al. (withdrawn)
UniProt, Q96PE6, ZIM3_Human (Year: 2021).*
NM_022552.4; *Homo sapiens* DNA methyltransferase 3 alpha (DNMT3A), transcript variant 3, mRNA (Year: 2021).*
NP_072046.2; DNA (cytosine-5)-methyltransferase 3A isoform a [*Homo sapiens*] (Year: 2021).*
UniProt, Q9CWR8, DNM3L_Mouse (Year: 2021).*
NP_001075164; DNA (cytosine-5)-methyltransferase 3-like isoform 1 [Mus musculus] (Year: 2021).*

(Continued)

*Primary Examiner* — Soren Harward
*Assistant Examiner* — Jenna L Persons
(74) *Attorney, Agent, or Firm* — COOLEY LLP

(57) ABSTRACT

Provided herein are gene repressor systems comprising fusion proteins, such as fusion proteins comprising a DNA binding domain such as a TALE, zinc finger or catalytically-dead CRISPR protein and guide nucleic acid (gRNA), which are useful in the repression of a proprotein convertase subtilisin/kexin Type 9 (PCSK9) gene. Also provided are methods of using such systems to repress transcription of PCSK9.

22 Claims, 98 Drawing Sheets

Specification includes a Sequence Listing.

(56) References Cited

U.S. PATENT DOCUMENTS

| | | | | |
|---|---|---|---|---|
| 11,519,004 | B2 | 12/2022 | Hunt et al. | |
| 11,560,555 | B2 | 1/2023 | Oakes et al. | |
| 11,680,254 | B2 | 6/2023 | Bartsevich et al. | |
| 11,795,472 | B2 | 10/2023 | Doudna et al. | |
| 11,873,504 | B2 | 1/2024 | Doudna et al. | |
| 11,976,277 | B2 | 5/2024 | Fernandes et al. | |
| 12,084,692 | B2 | 9/2024 | Oakes et al. | |
| 12,163,125 | B2 | 12/2024 | Vijayakumar et al. | |
| 2002/0160940 | A1 | 10/2002 | Case et al. | |
| 2006/0083780 | A1 | 4/2006 | Heyes et al. | |
| 2006/0240554 | A1 | 10/2006 | Chen et al. | |
| 2007/0059795 | A1 | 3/2007 | Moore et al. | |
| 2007/0192880 | A1 | 8/2007 | Muyan et al. | |
| 2011/0071208 | A1 | 3/2011 | Maclachlan et al. | |
| 2011/0076335 | A1 | 3/2011 | Yaworski et al. | |
| 2011/0117125 | A1 | 5/2011 | Hope et al. | |
| 2012/0207744 | A1 | 8/2012 | Mendlein et al. | |
| 2013/0137174 | A1 | 5/2013 | Zhang et al. | |
| 2016/0153005 | A1 | 6/2016 | Zhang et al. | |
| 2016/0304872 | A1 | 10/2016 | Elowitz et al. | |
| 2017/0369870 | A1 | 12/2017 | Gill et al. | |
| 2018/0064827 | A1 | 3/2018 | Conway et al. | |
| 2018/0163213 | A1 | 6/2018 | Aneja et al. | |
| 2018/0237787 | A1 | 8/2018 | Maianti et al. | |
| 2018/0258424 | A1 | 9/2018 | Greenberg et al. | |
| 2019/0127713 | A1 | 5/2019 | Gersbach et al. | |
| 2019/0276842 | A1 | 9/2019 | Doudna et al. | |
| 2019/0284572 | A1 | 9/2019 | Hunt et al. | |
| 2019/0336608 | A1 | 11/2019 | Baumhof et al. | |
| 2019/0338308 | A1 | 11/2019 | Sontheimer et al. | |
| 2019/0345500 | A1 | 11/2019 | Si Tayeb et al. | |
| 2019/0381180 | A1 | 12/2019 | Baumhof et al. | |
| 2019/0382798 | A1* | 12/2019 | Cowan ................. | C12N 15/907 |
| 2020/0017879 | A1 | 1/2020 | Doudna et al. | |
| 2020/0087641 | A1 | 3/2020 | Zhang et al. | |
| 2020/0121809 | A1 | 4/2020 | Hope et al. | |
| 2020/0131489 | A1 | 4/2020 | Bartsevich et al. | |
| 2020/0143907 | A1 | 5/2020 | Engreitz et al. | |
| 2020/0248168 | A1 | 8/2020 | Lundberg et al. | |
| 2020/0376140 | A1 | 12/2020 | Jarjour et al. | |
| 2020/0392541 | A1 | 12/2020 | Zhang et al. | |
| 2021/0002724 | A1 | 1/2021 | Damask et al. | |
| 2021/0009997 | A1 | 1/2021 | Wu et al. | |
| 2021/0060179 | A1 | 3/2021 | Conway et al. | |
| 2021/0139918 | A1 | 5/2021 | Chen et al. | |
| 2021/0269493 | A1 | 9/2021 | Li et al. | |
| 2021/0278420 | A1 | 9/2021 | Cariou et al. | |
| 2021/0284981 | A1 | 9/2021 | Doudna et al. | |
| 2021/0309981 | A1 | 10/2021 | Doudna et al. | |
| 2022/0064652 | A1 | 3/2022 | Horowitz et al. | |
| 2022/0090127 | A1 | 3/2022 | Miccio et al. | |
| 2022/0168231 | A1 | 6/2022 | Xu et al. | |
| 2022/0177872 | A1 | 6/2022 | Oakes et al. | |
| 2022/0195069 | A1 | 6/2022 | Soran | |
| 2022/0220508 | A1 | 7/2022 | Oakes et al. | |
| 2022/0348925 | A1 | 11/2022 | Oakes et al. | |
| 2022/0389447 | A9 | 12/2022 | Sontheimer et al. | |
| 2023/0028178 | A1 | 1/2023 | Doudna et al. | |
| 2023/0096554 | A1 | 3/2023 | Jaenisch et al. | |
| 2023/0124880 | A1 | 4/2023 | Oakes et al. | |
| 2023/0158174 | A1 | 5/2023 | Chadwick et al. | |
| 2023/0159926 | A1 | 5/2023 | Chadwick et al. | |
| 2023/0167424 | A1 | 6/2023 | Oakes et al. | |
| 2023/0175014 | A1 | 6/2023 | Breton et al. | |
| 2023/0183689 | A1 | 6/2023 | Bose | |
| 2023/0287391 | A1 | 9/2023 | Taipale et al. | |
| 2023/0340439 | A1 | 10/2023 | Qi et al. | |
| 2023/0340471 | A1 | 10/2023 | Naldini et al. | |
| 2023/0407276 | A1 | 12/2023 | Doudna et al. | |
| 2024/0026342 | A1 | 1/2024 | Chen et al. | |
| 2024/0026352 | A1 | 1/2024 | Gersbach et al. | |
| 2024/0026385 | A1 | 1/2024 | Vijayakumar et al. | |
| 2024/0033377 | A1 | 2/2024 | Mohr et al. | |
| 2024/0052328 | A1 | 2/2024 | Kwon et al. | |
| 2024/0076678 | A1 | 3/2024 | Maeder et al. | |
| 2024/0124537 | A1 | 4/2024 | Fernandes et al. | |
| 2024/0148665 | A1 | 5/2024 | Illendula et al. | |
| 2024/0167052 | A1 | 5/2024 | Doudna et al. | |
| 2024/0207196 | A1 | 6/2024 | Oakes et al. | |
| 2024/0254466 | A1 | 8/2024 | Fernandes et al. | |
| 2024/0360474 | A1 | 10/2024 | Baney et al. | |
| 2024/0376462 | A1 | 11/2024 | Vijayakumar et al. | |
| 2024/0392271 | A1 | 11/2024 | Fernandes et al. | |
| 2025/0011756 | A1 | 1/2025 | Vijayakumar et al. | |
| 2025/0043262 | A1 | 2/2025 | Oakes et al. | |
| 2025/0136962 | A1 | 5/2025 | Oakes et al. | |

FOREIGN PATENT DOCUMENTS

| | | | | |
|---|---|---|---|---|
| EP | 4 133 072 | A2 | 2/2023 | |
| EP | 4 158 009 | A2 | 4/2023 | |
| EP | 4 196 505 | A1 | 6/2023 | |
| EP | 4 208 545 | A1 | 7/2023 | |
| EP | 4 244 345 | A1 | 9/2023 | |
| EP | 4 267 743 | A2 | 11/2023 | |
| EP | 4 132 591 | A4 | 4/2024 | |
| EP | 4 374 004 | A2 | 5/2024 | |
| WO | WO-96/10390 | A1 | 4/1996 | |
| WO | WO-03/072788 | A1 | 9/2003 | |
| WO | WO-2009/127060 | A1 | 10/2009 | |
| WO | WO-2010/075303 | A1 | 7/2010 | |
| WO | WO-2011/012316 | A2 | 2/2011 | |
| WO | WO-2011/012316 | A3 | 2/2011 | |
| WO | WO-2012/068627 | A1 | 5/2012 | |
| WO | WO-2013/176772 | A1 | 11/2013 | |
| WO | WO-2016/094845 | A2 | 6/2016 | |
| WO | WO-2016/094845 | A3 | 6/2016 | |
| WO | WO-2017/077386 | A1 | 5/2017 | |
| WO | WO-2017/180915 | A2 | 10/2017 | |
| WO | WO-2018/049009 | A2 | 3/2018 | |
| WO | WO-2018/049009 | A3 | 3/2018 | |
| WO | WO-2018/064208 | A1 | 4/2018 | |
| WO | WO-2018/064371 | A1 | 4/2018 | |
| WO | WO-2018/087391 | A1 | 5/2018 | |
| WO | WO-2018/119354 | A1 | 6/2018 | |
| WO | WO-2018/154380 | A1 | 8/2018 | |
| WO | WO-2018/195449 | A1 | 10/2018 | |
| WO | WO-2018/195555 | A1 | 10/2018 | |
| WO | WO-2018/220211 | A1 | 12/2018 | |
| WO | WO-2019/070974 | A1 | 4/2019 | |
| WO | WO-2019/079462 | A1 | 4/2019 | |
| WO | WO-2019/084148 | A1 | 5/2019 | |
| WO | WO-2019/094791 | A2 | 5/2019 | |
| WO | WO-2019/126762 | A2 | 6/2019 | |
| WO | WO-2019/126762 | A3 | 6/2019 | |
| WO | WO-2019/183123 | A1 | 9/2019 | |
| WO | WO-2019/204766 | A1 | 10/2019 | |
| WO | WO-2019/213183 | A1 | 11/2019 | |
| WO | WO-2020/000461 | A1 | 1/2020 | |
| WO | WO-2020/005869 | A2 | 1/2020 | |
| WO | WO-2020/010186 | A1 | 1/2020 | |
| WO | WO-2020/023529 | A1 | 1/2020 | |
| WO | WO-2020/041456 | A1 | 2/2020 | |
| WO | WO-2020/049026 | A1 | 3/2020 | |
| WO | WO-2020/102709 | A1 | 5/2020 | |
| WO | WO-2020/156575 | A1 | 8/2020 | |
| WO | WO-2020/216962 | A1 | 10/2020 | |
| WO | WO-2020/229718 | A1 | 11/2020 | |
| WO | WO-2020/236670 | A1 | 11/2020 | |
| WO | WO-2020/247604 | A1 | 12/2020 | |
| WO | WO-2020/247883 | A2 | 12/2020 | |
| WO | WO-2020/247883 | A3 | 12/2020 | |
| WO | WO-2020247882 | A1 * | 12/2020 | ............. C12N 15/11 |
| WO | WO-2021/026336 | A2 | 2/2021 | |
| WO | WO-2021/026336 | A3 | 2/2021 | |
| WO | WO-2021/050601 | A1 | 3/2021 | |
| WO | WO-2021/113772 | A1 | 6/2021 | |
| WO | WO-2021/142342 | A1 | 7/2021 | |
| WO | WO-2021/188729 | A1 | 9/2021 | |
| WO | WO-2021/207651 | A2 | 10/2021 | |
| WO | WO-2021/207651 | A3 | 10/2021 | |
| WO | WO-2021/222238 | A1 | 11/2021 | |
| WO | WO-2021/242870 | A1 | 12/2021 | |
| WO | WO-2021247570 | A2 * | 12/2021 | ......... A61K 31/7088 |

(56) References Cited

FOREIGN PATENT DOCUMENTS

WO WO-2022/002160 A1 1/2022
WO WO-2022/032397 A1 2/2022
WO WO-2022/040909 A1 3/2022
WO WO-2022/042557 A1 3/2022
WO WO-2022/046873 A1 3/2022
WO WO-2022/060871 A1 3/2022
WO WO-2022/103839 A1 5/2022
WO WO-2022/120089 A1 6/2022
WO WO-2022/120094 A2 6/2022
WO WO-2022/120094 A3 6/2022
WO WO-2022/120095 A1 6/2022
WO WO-2022/125843 A1 6/2022
WO WO-2022/140577 A2 6/2022
WO WO-2022/140577 A3 6/2022
WO WO-2022/159758 A1 7/2022
WO WO-2022/162247 A1 8/2022
WO WO-2022/232232 A1 11/2022
WO WO-2022/241059 A1 11/2022
WO WO-2022/261148 A2 12/2022
WO WO-2022/261148 A3 12/2022
WO WO-2022/261149 A2 12/2022
WO WO-2022/261149 A3 12/2022
WO WO-2022/261150 A2 12/2022
WO WO-2022/261150 A3 12/2022
WO WO-2023/004338 A2 1/2023
WO WO-2023/004338 A3 1/2023
WO WO-2023/004430 A1 1/2023
WO WO-2023/039378 A1 3/2023
WO WO-2023/049299 A2 3/2023
WO WO-2023/049299 A3 3/2023
WO WO-2023/049742 A2 3/2023
WO WO-2023/049742 A3 3/2023
WO WO-2023/049872 A2 3/2023
WO WO-2023/049872 A3 3/2023
WO WO-2023/055893 A1 4/2023
WO WO-2023/093862 A1 6/2023
WO WO-2023/138617 A1 7/2023
WO WO-2023/165597 A1 9/2023
WO WO-2023/173110 A1 9/2023
WO WO-2023/178280 A2 9/2023
WO WO-2023/178280 A3 9/2023
WO WO-2023215711 A1 * 11/2023 ......... C12N 15/1137
WO WO-2023/235818 A2 12/2023
WO WO-2023/235818 A3 12/2023
WO WO-2023/235888 A2 12/2023
WO WO-2023/235888 A3 12/2023
WO WO-2023/240027 A1 12/2023
WO WO-2023/240074 A1 12/2023
WO WO-2023/240076 A1 12/2023
WO WO-2023/240162 A1 12/2023
WO WO-2023/241669 A1 12/2023
WO WO-2023/247789 A1 12/2023
WO WO-2023/250148 A1 12/2023
WO WO-2023/250183 A2 12/2023
WO WO-2023/250183 A3 12/2023
WO WO-2023/250511 A2 12/2023
WO WO-2023/250511 A3 12/2023
WO WO-2024/032681 A1 2/2024
WO WO-2024/061296 A2 3/2024
WO WO-2024/061296 A3 3/2024
WO WO-2024/129976 A2 6/2024
WO WO-2024/131940 A1 6/2024
WO WO-2024/137766 A2 6/2024
WO WO-2024/137766 A3 6/2024
WO WO-2024/206555 A1 10/2024
WO WO-2024/206565 A1 10/2024
WO WO-2024/206620 A1 10/2024
WO WO-2024/206676 A1 10/2024
WO WO-2014/204726 A1 12/2024

OTHER PUBLICATIONS

Cao et al., Sep. 15, 2021, "A CRISPR/dCasX-mediated transcriptional programming system for inhibiting the progression of bladder cancer cells by repressing c-MYC or activating TP53" Clinical and Translational Medicine, 11(9):e537 (Year: 2021).*

Thakore et al., Apr. 26, 2018, "RNA-guided transcriptional silencing in vivo with *S. aureus* CRISPR-Cas9 repressors" Nature Communications, (2018)9:1674 (Year: 2018).*

Liu et al., Jul. 23, 2015, "CRISPR-ERA: a comprehensive design tool for CRISPR-mediated gene editing, repression and activation" Bioinformatics, 31(22), p. 3676-3678 (Year: 2015).*

Low Quality Protein: uncharacterized protein LOC113423579 [Notechis scutatus], NCBI Reference Sequence: XP_026540821.1 (Year: 2018).*

Gastrula zinc finger protein XICGF26.1-like [Pantherophis guttatus], NCBI Reference Sequence: XP_060539208.1 (Year: 2023).*

Zinc finger protein 73, partial [Ophiophagus hannah], GenBank: ETE64866.1 (Year: 2013).*

Zinc finger protein 2-like [Pseudonaja textilis], NCBI Reference Sequence: XP_026576870.1 (Year: 2018).*

Tycko et al., Dec. 23, 2020, "High-Throughput Discovery and Characterization of Human Transcriptional Effectors" Cell, 183, p. 2020-2035 (Year: 2020).*

Stoll et al., Mar. 17, 2022, "Structure and functional mapping of the KRAB-KAP1 repressor complex" bioRxiv, doi: 10.1101/2022.03.17.484746, p. 1-29 and Supplementary Figures and Figure Legends (Year: 2022).*

Alerasool et al., 2020, "An efficient KRAB domain for CRISPRi applications in human cells" Nature Methods, vol. 17, p. 1093-1096 (Year: 2020).*

Guo et al., 2015, "Structural insight into autoinhibition and histone H3-induced activation of DNMT3A" Nature, vol. 517, p. 640-646 and Extended Data (Year: 2015).*

Tsuchida et al., Mar. 17, 2022, Molecular Cell, 82, p. 1199-1209 (Year: 2022).*

Chain D, RNA (121-MER); PDB: 7WB1_D; available Mar. 16, 2022 (Year: 2022).*

Liu et al., Feb. 14, 2019, Nature, vol. 566, p. 218-226 and Extended Data, referred to as "Doudna" reference throughout (Year: 2019).*

Zinc finger protein 28-like protein, partial [Bos mutus] GenBank: ELR48303.1 (Year: 2015).*

Zinc finger protein 136 [Rattus norvegicus] NCBI Reference Sequence: XP_006253017.1 (Year: 2021).*

Putative LOC102084796 [Columba livia] GenBank: PKK17646.1 (Year: 2017).*

Abaandou, L. et al. (2021). "Affecting HEK293 cell growth and production performance by modifying the expression of specific genes," Cells 10:1667, 21 pages.

Aguilera, T.A. et al. (Jun. 2009). "Systemic in vivo distribution of activatable cell penetrating peptides is superior to that of cell penetrating peptides," Integr. Biol. (Camb) 1(5-6):371-381.

Aldosari, B.N. et al. (2021). "Lipid Nanoparticles as Delivery Systems for RNA-Based Vaccines," Pharmaceutics 13:206, 26 total pages.

Alerasool, N. et al. (2020). "An efficient KRAB domain for CRISPRi applications," Nat. Methods 17:1093-1096, 14 total pages.

Alignment of SEQ ID No. 8 (2022). DNMT3A sequence disclosed in Siddique, A.N. et al. (2013). J. Mol. Biol. 425:479-491, 2 total pages.

Altschul, S.F. et al. (1990). "Basic local alignment search tool," J. Mol. Biol. 215:403-410.

Amabile, A. et al. (2016). "Inheritable Silencing of Endogenous Genes by Hit-and-Run Targeted Epigenetic Editing," Cell 167:219-232.

Author Unkown (1988). "Report of the National Cholesterol Education Program Expert Panel on Detection, Evaluation, and Treatment of High Blood Cholesterol in Adults," Arch. Intern Med. 148:36-69.

Ayyanathan, K. et al. (2003). "Regulated recruitment of HP1 to a euchromatic gene induces mitotically heritable, epigenetic gene silencing: a mammalian cell culture model of gene variegation," Genes & Develop. 17:1855-1869.

Bailey, T.L. (2021). "STREME: Accurate and versatile sequence motif discovery," Bioinformatics 37:2834-2840.

Barbier, A.J. et al. (2022). "The clinical progress of mRNA vaccines and Immunotherapies," Nature Biotechnology 40:840-854.

(56) References Cited

OTHER PUBLICATIONS

Basila, M. et al. (2017). “Minimal 2'-O-methyl phosphorothioate linkage modification pattern of synthetic guide RNAs for increased stability and efficient CRISPR-Cas9 gene editing avoiding cellular toxicity,” PLoS One 12:e0188593, 19 total pages.
Benjannet, S. et al. (2004). “NARC-1/PCSK9 and its natural mutants: zymogen cleavage and effects on the low density lipoprotein (LDL) receptor and LDL cholesterol,” J. Biol. Chem. 279:48865-48875.
Berge, K. et al. (2006). “Missense mutations in the PCSK9 gene are associated with hypocholesterolemia and possibly increased response to statin therapy,” Arterioscler. Throm. Vasc. Biol. 26:1094-1100.
Blesa, S. et al. (2008). “A new PCSK9 gene promoter variant affects gene expression and causes autosomal dominant hypercholesterolemia,” J. Clin. Endocrinol. & Metab. 93:3577-3583.
Braliou, G.G. et al. (2001). “The v-ErbA oncoprotein quenches the activity of an erythroid-specific enhancer,” Oncogene 20:775-787.
Brezgin, S. et al. (2019). “Dead Cas Systems: Types, Principles, and Applications,” International Journal of Molecular Sciences 20:6041, 26 total pages.
Broude, E.V. et al. (2007). “p21 (CDKN1A) is a negatice regulator of p53 stability,” Cell Cycle 6:1468-1471.
Burstein, D. et al. (Feb. 2017). “New CRISPR-Cas systems from uncultivated microbes,” Nature 542:237-241. Published online Dec. 22, 2016, with Supplemental Materials, 28 total pages.
Carreras, A. et al. (2019). “In vivo genome and base editing of a human PCSK9 knock-in hypercholesterolemic mouse model,” BMC Biology 17:4, 14 total pages.
Chadwick, A.C. et al. (2017). “Treatment of Dyslipidemia Using CRISPR/Cas9 Genome Editing,” Curr. Atheroscler Rep. 19:32, 10 total pages.
Chadwick, A.C. et al. (2017). “In Vivo Base Editing of PCSK9 (Proprotein Convertase Subtilisin/Kexin Type 9) as a Therapeutic Alternative to Genome Editing,” Arterioscler Thromb. Vasc. Biol. 37:1741-1747.
Chadwick, A.C. et al. (2018). “Reduced Blood Lipid Levels With In Vivo CRISPR-Cas9 Base Editing of ANGPTL3,” Circulation 137:975-977.
Chen, B. et al. (2003). “Influence of histidine on the stability and physical properties of a fully human antibody in aqueous and solid forms,” Pharm. Res. 20:1952-1960.
Chen, J. et al. (2016). “Production and clinical development of nanoparticles for gene delivery,” Mol. Ther. Methods Clin. Dev. 3:16023.
Cortes-Mancera, F.M. et al. (2022). “Gene-targeted DNA methylation: Towards long-lasting reprogramming of gene expression?” Adv. Exp. Med. Biol. 1389:515-533.
Cullis, P.R. et al. (2017). “Lipid Nanoparticle Systems for Enabling Gene Therapies,” Mol. Ther. 25:1467-1475.
Das, A.T. et al. (2016). “Tet-On systems for doxycycline-inducible gene expression,” Curr. Gene Ther. 16:156-167.
Ding, Q. et al. (2014). “Permanent Alteration of PCSK9 With In Vivo CRISPR-Cas9 Genome Editing,” Circ. Res. 115:488-492.
Ference, B.A. et al. (2018). “Impact of lipids on cardiovascular health,” J. American Coll. Cardiol. 72:1141-1156.
Ference, B.A. et al. (2016). “Variation in PCSK9 and HMGCR and risk of cardiovascular disease and diabetes,” New Engl. J. Med. 375:2144-2153.
Fiddes, I.T. et al. (2018). “Comparative Annotation Toolkit (CAT)-simultaneous clade and personal genome annotation,” Genome Res. 28:1029-1038.
Finn, J.D. et al. (2018). “A Single Administration of CRISPR/Cas9 Lipid Nanoparticles Achieves Robust and Persistent In Vivo Genome Editing,” Cell Reports 22:2227-2235.
Fritz, C.C. et al. (1996). “HIV Rev uses a conserved cellular protein export pathway for the nucleocytoplasmic transport of viral RNAs,” Current Biol. 67:848-854.
Fujimori, T. et al. (Oct. 2023). “Single-cell chromatin state transitions during epigenetic memory formation,” bioRxiv, 30 pages.
Fuks, F. (2005). “DNA methylation and histone modifications: Teaming up to silence genes,” Curr. Opin. Genet. Develop. 15:490-495.
Genbank NCBI Reference Sequence NG_009060.1, *Homo sapiens* low density lipoprotein receptor (LDLR), RefSeqGene (LRG_274) on chromosome 19, 2019, 16 total pages.
Genbank NCBI Reference Sequence NG_009061.1, *Homo sapiens* proprotein convertase subtilisin/kexin type 9 (PCSK9), RefSeqGene (LRG_275) on chromosome 1, 2019, 11 total pages.
Ghirlando, R. et al. (1999). “Glycosylation of human IgG-Fc: influences on structure revealed by differential scanning micro-calorimetry,” Immunol Letters 68:47-52.
Guevara, M.L. et al. (2020). “Advanced in lipid nanoparticles for mRNA-based cancer immunotherapy,” Frontiers in Chemistry 8:1-17.
Guo, X. et al. (Jan. 2015). “Structural insight into autoinhibition and histone H3-induced activation of DNMT3A,” Nature 517:640-644.
Haberle, V. et al. (2018). “Eukaryotic core promoters and the functional basis of transcription initiation.,” Nat. Rev. Mol. Cell. Biol. 19:621-637, 40 pages provided.
Hendel, A. et al. (2015). “Chemically modified guide RNAs enhance CRISPR-Cas genome editing in human primary cells,” Nature Biotechnology 33:985-989.
Herbert, B. et al. (2010). “Increased secretion of lipoproteins in transgenic mice expressing human D374Y PCSK9 under physiological genetic control,” Arterioscler. Thromb. Vasc. Biol. 30:1333-1339.
Hermonat, P.L. et al. (1984). “Use of adeno-associated virus as a mammalian DNA cloning vector: Transduction of neomycin resistance into mammalian tissue culture cells,” PNAS 81:6466-6470.
Hochstrasser, M.L. et al. (2014). “CasA mediates Cas3-catalyzed target degradation during CRISPR RNA-guided interference,” PNAS 111:6618-6623.
Innovative Genomics Institute (2019). “The little enzyme that can: Meet the gene editor CasX,” Press release from Innovative Genomics Institute, 13 pages.
International Search Report mailed on Apr. 26, 2021, for PCT Application No. PCT/US2021/012804, filed on Jan. 8, 2021, 6 pages.
International Search Report mailed on Mar. 30, 2023, for PCT Application No. PCT/US2022/076774, filed on Sep. 21, 2022, 11 pages.
International Search Report mailed on Oct. 10, 2023, for PCT Application No. PCT/US2023/067985, filed on Jun. 6, 2023, 6 pages.
International Search Report mailed on Aug. 16, 2023, for PCT Application No. PCT/US2023/067987, filed on Jun. 6, 2023, 7 pages.
International Search Report mailed on Jul. 11, 2024, for PCT Application No. PCT/US2024/021853, filed on Mar. 28, 2024, 7 pages.
International Search Report mailed on Aug. 5, 2024, for PCT Application No. PCT/US2024/021866, filed on Mar. 28, 2024, 6 pages.
Jackson, A.L. et al. (2003). “Expression profiling reveals off-target gene regulation by RNAi,” Nat. Biotechnol. 21:635-637.
Jain, S. et al. (2021). “TALEN outperforms Cas9 in editing heterochromatin target sites,” Nat. Commun. 12:606, 10 total pages.
Jarmoskaite I. et al. (2019). “A quantitative and predictive model for RNA binding by human pumilio proteins,” Mol. Cell. 74:966-981, 65 pages provided.
Kabadi, A.M. et al. (2014). “Engineering synthetic TALE and CRISPR/Cas9 transcription factors for regulating gene expression,” Methods 69:188-197.
Kao, T-H. et al. (2014). “Ectopic DNMT3L triggers assembly of a repressive complex for retroviral silencing in somatic cells,” J. Virology 88:10680-10695.
Karemaker, I.D. et al. (Aug. 2020). “DNA methyltransferases hitchhiking on chromatin,” Swiss Med. Wkly. 150:w20329, 9 pages.
Katzmann, J. et al. (2022). “Gene Therapy Targeting PCSK9,” Metabolites 12:70, 13 total pages.

(56) References Cited

OTHER PUBLICATIONS

Kim, M. et al. (2021). "Engineered ionizable lipid nanoparticles for targeted delivery of RNA therapeutics into different types of cells in the liver," Sci. Adv. 7:eabf4398, 12 total pages.
Kim, S-H. et al. (2007). "Zinc-fingers and homeoboxes 1 (ZHX1) binds DNA methyltransferase (DNMT) 3B to enhance DNMT3B-mediated transcriptional repression," Biochem. Biophys. Res. Commun. 355:318-323.
King, A. (2018). "The heart-disease vaccine," Nature 555:S23-S25.
Kocak, D.D. (2013). "Synthetic Transcription Factors and their Effects on Endogenous DNA Methylation in Human Cells," Thesis submitted in partial fulfillment of the requirements for the degree of Master of Science in the Department of Biomedical Engineering in the Graduate School of Duke University, 35 total pages.
Kotin, R.M. (1994). "Prospects for the use of adeno-associated virus as a vector for human gene therapy," Human Gene Therapy 5:793-801.
Kuhnel, F. et al. (2004). "Tumor-specific adenoviral gene therapy: transcriptional repression of gene expression by utilizing p53-signal transduction pathways," Cancer Gene Ther. 11:28-40.
Li, W. et al. (2014). "MAGeCK enables robust identification of essential genes from genome-scale CRISPR/Cas9 knockout screens," Genome Biol. 15:554, 12 total pages.
Li, H. et al. (2006). "The histone methyltransferase SETDB1 and the DNA methyltransferase DNMT3A interact directly and localize to promoters silenced in cancer cells," J. Biol. Chem. 281:19489-19500.
Li, F. et al. (2007). "Chimeric DNA methyltransferases target DNA methylation to specific DNA sequences and repress expression of target genes," Nucleic Acids Res. 35:100-112.
Li, Q. et al. (Feb. 2021). "In vivo PCSK9 gene editing using an all-in-one self-cleavage AAV-CRISPR system," Mol. Ther. Meth. Clin. Dev. 20:652-659.
Liu, J.J. et al. "CasX enzymes comprise a distinct family of RNA-guided genome editors," Nature 566:218-223. Published online Feb. 4, 2019.
Liu, J.J. et al. CasX enzymes comprise a distinct family of RNA-guided genome editors, Nature 568:E8-E10. (Author correction: published online Apr. 3, 2019).
Liu, Y. et al. (Dec. 2017). "Engineering cell signaling using tunable CRISPR-Cpf1-based transcription factors," Nat. Commun. 8(1):2095, 8 pages.
Lohoff, F.W. et al. (2018). "Methylomic profiling and replication implicates deregulation of PCSK9 in alcohol use disorder," Mol. Psychiatry 23:1900-1910.
Lorenz, R. et al. (2011). ViennaRNA Package 2.0. Algorithms Mol. Biol. 6:26.
Luo, M.L. et al. (2015). "Repurposing endogenous type I CRISPR-Cas systems for programmable gene repression," Nucl. Acids Res. 43:674-681.
Ma, A-N. et al. (2014). "Targeted gene suppression by inducing de novo DNA methylation in the gene promoter," Epigenetics and Chromatin 7:20, 11 total pages.
Makarova, K.S. et al. (2020). "Evolutionary classification of CRISPR-Cas systems: A burst of class 2 and derived variants," Nat. Rev. Microbiol. 18:67-83.
Mao, Y. et al. (2021). "A high-quality bonobo genome refines the analysis of hominid evolution," Nature 594:77-81.
Margres et al. (2021). "The tiger rattlesnake genome reveals a complex genotype underlying a simple venom phenotype," PNAS 118:e2014634118.
Mcinnes, L. et al. (2018). "UMAP: Uniform manifold approximation and projection for dimension reduction," ArXiv e-prints 1802.03426, pp. 1-63.
Mikaeeli, S. et al. (2020). "Functional analysis of natural PCSK9 mutants in modern and archaic humans," FEBS J. 287:515-528.
Moussa, H.F. et al. (2021). "Here to stay: Writing lasting epigenetic memories," Cell 184:2281-2283.
Murphy, K.E. et al. (2016). "The transcriptional repressive activity of KRAB zinc finger proteins does not correlate with their ability to recruit TRIM28," PLoS One 11:e0163555, 19 total pages.
Murray, A. et al. (2002). "Epitope Affinity Chromatography and Biophysical Studies of Monoclonal Antibodies and Recombinant Antibody Fragments," J. Chromatogr Sci 40:343-349.
Musunuru, K. et al. (2021). "In vivo CRISPR base editing of PCSK9 durably lowers cholesterol in primates," Nature 593:429-434, 22 total pages.
Musunuru, K. et al. (2022). "Moving toward genome-editing therapies for cardiovascular diseases," Journal of Clinical Investigation 132:e148555, 8 total pages.
National Cancer Institute (2015). "Cell lines in the In Vitro Screen," 5 total pages.
NCBI Reference Sequence NM_001407246.1 (Apr. 2024). "*Homo sapiens* proprotein convertase subtilisin/kexin type 9 (PCSK9), transcript variant 9, mRNA, " located at www.ncbi.nlm.nih.gov/nuccore/2245789805, accessed on Apr. 2, 2024, 5 pages.
NCBI Reference Sequence NP_001307822.1 (2016). "DNMT3A protein sequence," 3 pages.
Noguchi, H. et al. (Jul. 2003). "PDX-1 protein containing its own antennapedia-like protein transduction domain can transduce pancreatic duct and islet cells," Diabetes 52:1732-1737.
Non-Final Office Action mailed on Jun. 23, 2021, for U.S. Appl. No. 15/521,294, filed Apr. 23, 2017, 24 pages.
Non-Final Office Action mailed on Apr. 9, 2024, for U.S. Appl. No. 18/516,722, filed Nov. 21, 2023, 56 pages.
Non-Final Office Action mailed on Aug. 9, 2024, for U.S. Appl. No. 18/612,882, filed Mar. 21, 2024, 22 pages.
Nuñez, J.K. et al. (2021). "Genome-wide programmable transcriptional memory by CRISPR-based epigenome editing," Cell 184:2503-2519, 44 total pages.
O'Geen, H. et al. (2022). "Determinants of heritable gene silencing for KRAB-dCas9+DNMT3 and Ezh2-dCas9+DNMT3 hit-and-run epigenome editing," Nucl. Acids Res. 50:3239-3253.
O'Geen et al. (2019). "Ezh2-dCas9 and KRAB-dCas9 enable engineering of epigenetic memory in a context-dependent manner," Epigenetics Chromatin. 12:26, 20 pages.
Otani et al. (2009). "Structural basis for recognition of H3K4 methylation status by the DNA methyltransferase 3A ATRX-DNMT3-DNMT3L domain," EMBO Rep. 10(11):1235-1241.
Ordobadi, M. (Nov. 2019). "Lipid nanoparticles for delivery of bioactive molecules," A Thesis Submitted in Partial Fulfillment of the Requirements for the Degree of Doctor of Philosophy, The University of British Columbia (Vancouver), 140 total pages.
Orth, P. et al. (2000). "Structural basis of gene regulation by the tetracycline inducible Tet repressor-operator system," Nat. Struct. Biol. 7:215-219.
Pandit, S. et al. (2008). "Functional analysis of sites within PCSK9 responsible for hypercholesterolemia," J. Lipid Res. 49:1333-1343.
Park, S.W. et al. (2004). "Post-transcriptional regulation of low density lipoprotein receptor protein by proprotein convertase subtilisin/kexin type 9a in mouse liver," J. Biol. Chem. 279:50630-50638.
Policarpi, C. et al. (2021). "Epigenetic editing: Dissecting chromatin function in context," BioEssays 43:e2000316, 16 total pages.
Qi, L.S. et al. (Feb. 2013). "Repurposing CRISPR as an RNA-guided platform for sequence-specific control of gene expression," Cell 152:1173-1183.
Rivenbark, A. et al. (2012). "Epigenetic reprogramming of cancer cells via targeted DNA methylation," Epigenetics 7:350-360.
Rives, A. et al. (2021). "Biological structure and function emerge from scaling unsupervised learning to 250 million protein sequences," PNAS 118:e2016239118, 12 total pages.
Rodriguez, D. et al. (2016). "Epigenetic editing: On the verge of reprogramming gene expression at will," Curr. Genet. Med. Rep. 4:170-179.
Rosenson, R.S. et al. (2018). "The evolving future of PCSK9 inhibitors," J. American Coll. Cardiol. 72:314-329.
Rossidis, A.C. et al. (2018). "In utero CRISPR-mediated therapeutic editing of metabolic genes," Nat. Med. 24:1513-1518, 21 pages provided.
Sabatine, M.S. (2019). "PCSK9 inhibitors: Clinical evidence and implementation," Nature Reviews 16:155-165.

(56) References Cited

OTHER PUBLICATIONS

Samulski, R.J. et al. (1989). "Helper-Free Stocks of Recombinant Adeno-Associated Viruses: Normal Integration Does Not Require Viral Gene Expression," J. Virol. 63:3822-3828.
Schmitges, F.W. et al. (Dec. 2016). "Multiparameter functional diversity of human C2H2 zinc finger proteins," Genome Res. 26(12):1742-1752.
Schultz, D.C. et al. (2002). "SETDB1: a novel KAP-1-associated histone H3, lysine 9-specific methyltransferase that contributes to HP1-mediated silencing of euchromatic genes by KRAB zinc-finger proteins," Genes Dev. 16:919-932.
Schwartz, G.G. et al. (2018). "Alirocumab and cardiovascular outcomes after acute coronary syndrome," New Engl. J. Med. 379:2097-2107.
Seidah, N.G. et al. (2019). "Novel strategies to target proprotein convertase subtilisin kexin 9: beyond monoclonal antibodies," Cardiovasc. Res. 115:510-518.
Seidah, N.G. et al. (2003). "The secretory proprotein convertase neural apoptosis-regulated convertase 1 (NARC-1): liver regeneration and neuronal differentiation," PNAS 100:928-933.
Seidah, N.G. (2017). "The PCSK9 revolution and the potential of PCSK9-based therapies to reduce LDL-cholesterol," Glob. Cardiol. Sci. Pract. 2017: e201702, 22 total pages.
Shapiro, M.D. et al. (2018). "PCSK9: From basic science discoveries to clinical trials," Circ. Res. 122: 1420-1438, 40 total pages.
Siddique, A.N. et al. (2013). "Targeted Methylation and Gene Silencing of VEGF-A in Human Cells by Using a Designed Dnmt3a-Dnmt3L Single-Chain Fusion Protein with Increased DNA Methylation Activity," Journal of Molecular Biology 425:479-491.
Sigoillot, F.D. et al. (2012). "A bioinformatics method identifies prominent off-targeted transcripts in RNAi screens," Nat. Methods 9:363-366.
Smith, T.F. et al. (1981). "Comparison of biosequences," Adv. Appl. Math. 2:482-489.
Stepper, P. et al. (2016). "Efficient targeted DNA methylation with chimeric dCas9-Dnmt3a-Dnmt3L methyltransferase," Nucleic Acids Research 45:1703-1713.
Stepper, P. (2020). "CRISPR-Cas9 fusions for synthetic epigenetics," Institut für Biochemie und Technische Biochemie der Universität Stuttgart, 152 pages.
Stoll, G.A. et al. (2022). "Structure and functional mapping of the KRAB-KAP1 repressor complex," bioRxiv, 34 total pages.
Tajima, S. et al. (Nov. 2016). "Domain Structure of the Dnmt1, Dnmt3a, and Dnmt3b DNA Methyltransferases," DNA Methyltransferases—Role and Function, pp. 63-86.
Tratschin, J-D. et al. (1985). "Adeno-Associated Virus Vector for High-Frequency Integration, Expression, and Rescue of Genes in Mammalian Cells," Mol. Cell. Biol. 5:3251-3260.
Tratschin, J-D. et al. (1984). "A Human Parvovirus, Adeno-Associated Virus, as a Eucaryotic Vector: Transient Expression and Encapsidation of the Procaryotic Gene for Chloramphenicol Acetyltransferase," Mol. Cell. Biol. 4:2072-2081.
Tréhin, R. et al. (Jul. 2004). "Cellular uptake but low permeation of human calcitonin-derived cell penetrating peptides and Tat(47-57) through well-differentiated epithelial models," Pharm. Res. 21:1248-1256.
Tsuchida, C.A. et al. (2022). "Chimeric CRISPR-CasX enzymes and guide RNAs for improved genome editing activity," Mol. Cell 82:1199-1209, 28 pages provided.
Uribe, K.B. et al. (2021). "A Systematic Approach to Assess the Activity and Classification of PCSK9 Variants," Int. J. Mol. Sci. 22:13602, 15 total pages.
Vonk et al. (2013). "The king cobra genome reveals dynamic gene evolution and adaptation in the snake venom system," PNAS 110(51):20651-20656.
Vonk et al. (2013). "The king cobra genome reveals dynamic gene evolution and adaptation in the snake venom system," PNAS 110(51):20651-20656, Supplemental Information, 12 pages.
Walker, H. et al. (2021). "CRISPR Gene Editing in Lipid Disorders and Atherosclerosis: Mechanisms and Opportunities," Metabolites 11:857, 14 total pages.
Wang, X. et al. (2016). "CRISPR-Cas9 Targeting of PCSK9 in Human Hepatocytes In Vivo—Brief Report," Arterioscler Thromb. Vasc. Biol. 36:783-786.
Warren, W.C. et al. (2020). "Sequence diversity analyses of an improved rhesus macaque genome enhance its biomedical utility," Science 370:eabc6617, 26 total pages.
Wei, T. et al. (2020). "Systemic nanoparticle delivery of CRISPR-Cas9 ribonucleoproteins for effective tissue specific genome editing," Nat. Commun. 11:3232, 12 total pages.
Wender, P.A. et al. (Nov. 2000). "The design, synthesis, and evaluation of molecules that enable or enhance cellular uptake: peptoid molecular transporters," PNAS 97:13003-13008.
Whittaker, M. et al. (2023). "Epigenome Editing Durability Varies Widely Across Cardiovascular Disease Target Genes," bioRxiv, doi: 10.1101/2023.05.17.541156; 22 total pages.
Wolf, G. et al. (Oct. 2015). "Spotting the enemy within: Targeted silencing of foreign DNA in mammalian genomes by the Krüppel-associated box zinc finger protein family," Mobile DNA 6:17, 20 pages.
Written Opinion of the International Searching Authority mailed on Apr. 26, 2021, for PCT Application No. PCT/US2021/012804, filed on Jan. 8, 2021, 10 pages.
Written Opinion of the International Searching Authority mailed on Mar. 30, 2023, for PCT Application No. PCT/US2022/076774, filed on Sep. 21, 2022, 11 pages.
Written Opinion of the International Searching Authority mailed on Oct. 10, 2023, for PCT Application No. PCT/US2023/067985, filed on Jun. 6, 2023, 9 pages.
Written Opinion of the International Searching Authority mailed on Aug. 16, 2023, for PCT Application No. PCT/US2023/067987, filed on Jun. 6, 2023, 8 pages.
Written Opinion of the International Searching Authority mailed on Jul. 11, 2024, for PCT Application No. PCT/US2024/021853, filed on Mar. 28, 2024, 13 pages.
Written Opinion of the International Searching Authority mailed on Aug. 5, 2024, for PCT Application No. PCT/US2024/021866, filed on Mar. 28, 2024, 10 pages.
Xu, T-H. et al. (Oct. 2020). "Structure of nucleosome-bound DNA methyltransferases DNMT3A and DNMT3B," Nature 586:151-155.
Yang, H. et al. (May 2019). "CasX: a new and small CRISPR gene-editing protein," Cell Res. 29:345-346. Published online Apr. 16, 2019.
Yeo, N.C. et al. (Aug. 2018). "An enhanced CRISPR repressor for targeted mammalian gene regulation," Nat. Methods 15:611-616.
Yin, H. et al. (2017). "Structure-guided chemical modification of guide RNA enables potent non-viral in vivo genome editing," Nat. Biotechnol. 35:1179-1187, 22 pages provided.
Ying, Y. et al. (2015). "The Krüppel-associated box repressor domain induces reversible and irreversible regulation of endogenous mouse genes by mediating different chromatin states," Nucl. Acids Res. 43:1549-1561.
Yu, W. et al. (Oct. 2014). "Genome-wide DNA methylation patterns in LSH mutant reveals de-repression of repeat elements and redundant epigenetic silencing pathways," Genome Res. 24:1613-1623.
Zender, L. et al. (Jun. 2002). "VP22-mediated intercellular transport of p53 in hepatoma cells in vitro and in vivo," Cancer Gene Ther. 9:489-496.
Zhang, J. et al. (Jun. 1997). "PowerBLAST: a new network BLAST application for interactive or automated sequence analysis and annotation," Genome Res. 7:649-656.
Zhang, Y. et al. (2010). "Chromatin methylation activity of Dnmt3a and Dnmt3a/3L is guided by interaction of the ADD domain with the histone H3 tail.," Nucl. Acids Res. 38:4246-4253.
Zhao, X. et al. (2013). "Intracellular delivery of artificial transcription factors fused to the protein transduction domain of HIV-1 Tat," Protein Expression and Purification 90:27-33.
U.S. Appl. No. 17/791,130, filed Jan. 8, 2021, by Oakes et al.
U.S. Appl. No. 17/828,957, filed Dec. 4, 2020, by Oakes et al.
U.S. Appl. No. 18/193,571, filed Mar. 30, 2023, by Oakes et al.
U.S. Appl. No. 18/538,885, filed Dec. 13, 2023, by Oakes et al.

(56) References Cited

OTHER PUBLICATIONS

U.S. Appl. No. 18/693,062, filed Mar. 18, 2024, by Fernandes et al.
U.S. Appl. No. 18/612,882, filed Mar. 21, 2024, by Fernandes et al.
U.S. Appl. No. 18/608,127, filed Mar. 18, 2024, by Baney et al.
U.S. Appl. No. 18/568,029, filed Dec. 7, 2023, by Oakes et al.
U.S. Appl. No. 18/663,845, filed May 14, 2024, by Vijayakumar et al.
U.S. Appl. No. 18/617,117, filed Mar. 26, 2024, by Fernandes et al.
U.S. Appl. No. 18/778,393, filed Jul. 19, 2024, by Oakes et al.
U.S. Appl. No. 18/789,158, filed Jul. 30, 2024, by Vijayakumar et al.
Alhaji, S.Y. et al. (Apr. 2019). "Silencing of transgene expression in mammalian cells by DNA methylation and histone modifications in gene therapy perspective," Biotechnol. Genet. Eng. Rev. 35(1):1-25.
Amabile, A. et al. (May 2015). "Permanent epigenetic silencing of human genes with artificial transcriptional repressors," Molecular Therapy 23(Suppl. 1):S275, 1 page.
Cedar, H. (Apr. 1988). "DNA methylation and gene activity," Cell 53(1):3-4.
Da Dalt, L. et al. (2021). "PCSK9 deficiency rewires heart metabolism and drives heart failure with preserved ejection fraction," Europ. Heart. J. 42:3078-3090.
De Groote, M.L. et al. (Sep. 2012). "Epigenetic editing: Targeted rewriting of epigenetic marks to modulate expression of selected target genes," Nucl. Acids Res. 40(21):10596-10613.
Final Office Action mailed on Sep. 27, 2024, for U.S. Appl. No. 18/516,722, filed Nov. 21, 2023, 29 pages.
Final Office Action mailed on Dec. 23, 2024, for U.S. Appl. No. 18/612,882, filed Mar. 21, 2024, 20 pages.
Kaddoura, R. et al. (2020). "Efficacy and safety of PCSK9 monoclonal antibodies: an evidence-based review and update," Journal of Drug Assessment 9:129-144.
KRAB Domain Sequence in ZNF73 Protein (2014), Zinc Finger Protein 73, 7 pages.
Makarova, K.S. et al. (Nov. 2015). "An updated evolutionary classification of CRISPR-Cas systems," Nat. Rev. Microbiol. 13(11):722-736.
Nakamura, M. et al. (Jun. 2021). "Durable CRISPR-Based Epigenetic Silencing," Biodes. Res. 2021:9815820, 8 pages.
O'Geen, H. et al. (2017). "dCas9-based epigenome editing suggests acquisition of histone methylation is not sufficient for target gene repression," Nucl. Acids Res. 45:9901-9916.
Quenneville, S. et al. (2012). "The KRAB-ZFP/KAP1 system contributes to the early embryonic establishment of site-specific DNA methylation patterns maintained during development," Cell Rep. 2:766-773.
Salem, S. et al. (2023). "PCSK9 Involvement in Autism Etiology: Sequence Variations, Protein Concentration, and Promoter Methylation," Archiv. Med. Res. 54:102869, 15 pages.
Schunder, E. et al. (2013). "First indication for a functional CRISPR/Cas system in Francisella Tularensis," Int'l J. Med. Microbiol. 303:51-60.
Tak, Y.E. et al. (Dec. 2017). "Inducible and multiplex gene regulation using CRISPR-Cpf1-based transcription factors," Nature Methods 14(12):1163-1166.
Tang, X. et al. (2017). "A CRISPR-Cpf1 system for efficient genome editing and transcriptional repression in plants," Nature Plants 3:17018, 5 pages.
Urrutia, R. (Sep. 2003). "KRAS-containing zinc-finger repressor proteins," Genome Biology, vol. 4, Article No. 231, 8 pages.
Wang, X. et al. (2022). "Abstract 125: Reversible Epigenome Editing of PCSK9 as a Therapeutic Strategy," Arteriosclerosis Thrombosis Vascular Biol. 42 Suppl. 1: Abstract 125, 1 page.
Xia, X-D. et al. (Oct. 2021). "Regulation of PCSK9 Expression and Function: Mechanisms and Therapeutic Implications," Frontiers in Cardiovascular Medicine vol. 8, Article 764038, 13 pages.
Zetsche, B. et al. (Oct. 2015). "Cpf1 is a single RNA-guided endonuclease of a class 2 CRISPR-cas system," Cell 163:759-771.
U.S. Appl. No. 62/148,366, filed Apr. 16, 2015, by Elowitz et al.
U.S. Appl. No. 18/872,544, filed Dec. 6, 2024, by Wright et al.
U.S. Appl. No. 18/909,093, filed Oct. 8, 2024, by Oakes et al.
Chen, X. et al. (2012). "Fusion protein linkers: Property, design and functionality," Advanced Drug Delivery Reviews 65(10):1357-1369.
Mlambo, T. et al. (2018). "Designer epigenome modifiers enable robust and sustained gene silencing in clinically relevant human cells," Nucleic Acids Research 46(9):4456-4468.
Yamazaki, T. et al. (2017). "Targeted DNA methylation in pericentromeres with genome editing- based artificial DNA methyltransferase," PLoS One 12(5):e0177764, 18 pages.
Yamazaki, T. et al. (2007). "Time-lapse and retrospective analysis of DNA methylation in mouse preimplantation embryos by live cell imaging," Development Biol. 304(2007):409-419.
U.S. Appl. No. 18/869,765, filed Jun. 1, 2023, by Zhou et al.
U.S. Appl. No. 18/872,584, filed Jun. 7, 2023, by Deiter et al.
Delrosso, N. et al. (Apr. 2023). "Large-scale mapping and mutagenesis of human transcriptional effector domains," Nature 616(7956):365-372.
Jia, D. et al. (Sep. 2007). "Structure of Dnmt3a bound to Dnmt3L suggests a model for de novo DNA methylation," Nature 449(7159):248-251.
Li, B. et al. (2018). "Design and assessment of engineered CRISPR—Cpf1 and its use for genome editing," Nat. Protoc. 13:899-914.
Mohr, S.E. et al. (2016). "CRISPR guide RNA design for research applications," FEBS J. 283(17):3232-3238.
Mukund, A.X. et al. (Sep. 2023). "High-throughput functional characterization of combinations of transcriptional activators and repressors," Cell Systems 14(9):746-763.
Non-Final Office Action mailed on Feb. 18, 2025, for U.S. Appl. No. 18/516,722, filed Nov. 21, 2023, 30 pages.
Ungerer, J. et al. (2016). "Cpf1 Is a Versatile Tool for CRISPR Genome Editing Across Diverse Species of Cyanobacteria," Scientific Reports 6:39681, 9 pages.
BPS Bioscience (2025). "Cholesterol and the PCKS9 Pathway," located at bpsbioscience.com, retrieved on Jun. 4, 2025, 4 pages.
Final Office Action mailed on Jun. 11, 2025, for U.S. Appl. No. 18/516,722, filed Nov. 21, 2023, 46 pages.
Lambert, G. et al. (Dec. 2012). "The PCSK9 decade," J. Lipid. Res. 53(12):2515-2524.
Matsui, M. et al. (Dec. 2010). "Activation of LDL Receptor Expression by Small RNAs Complementary to a Noncoding Transcript that Overlaps the LDLR Promoter," Chem. Biol 17(12):1344-1355.
Non-Final Office Action mailed on Jun. 2, 2025, for U.S. Appl. No. 18/612,882, filed Mar. 21, 2024, 12 pages.
Notice of Allowance mailed on Sep. 30, 2025, for U.S. Appl. No. 18/612,882, filed Mar. 21, 2024, 6 pages.
Santos, R.D. et al. (Feb. 2020). "Long-Term Evolocumab in Patients with Familial Hypercholesterolemia," J. Am. Coll. Cardiol. 75(6):565-574.
U.S. Appl. No. 19/343,824, filed Sep. 29, 2025, by Fernandes et al.
U.S. Appl. No. 19/343,818, filed Sep. 29, 2025, by Fernandes et al.

* cited by examiner

316

Motif 3:

Alternative motif 1:

Alternative motif 2:

Alternative motif 3:

Alternative motif 4:

Untreated vs. LTRP5-ADD-ZIM3 + NT spacer (Day26)

Untreated vs. LTRP5-ADD-ZIM3 + NT spacer (Day6)

COMPOSITIONS AND METHODS FOR THE TARGETING OF PCSK9

CROSS REFERENCE TO RELATED APPLICATIONS

This application is a continuation of PCT/US2023/067987, filed on Jun. 6, 2023, which claims priority to, and benefit of, U.S. Provisional Application Nos. 63/349,981 filed on Jun. 7, 2022, 63/492,923, filed on Mar. 29, 2023, and 63/505,823, filed on Jun. 2, 2023, the contents of each of which are incorporated by reference herein in their entireties.

REFERENCE TO AN ELECTRONIC SEQUENCE LISTING

The contents of the electronic sequence listing (SCRB_055_04US_2ndSubSeqList_ST26.xml; Size: 4,366,821 bytes; and Date of Creation: Aug. 5, 2024) are herein incorporated by reference in their entirety.

BACKGROUND

In mammals, cholesterol is transported within lipoproteins via emulsification. The lipoprotein particles are classified based on their density: low-density lipoproteins (LDL), very low-density lipoproteins (VLDL), high-density lipoproteins (HDL), and chylomicrons. Surface LDL receptors are internalized during cholesterol absorption. A cell with abundant cholesterol will have its LDL receptor synthesis blocked to prevent new cholesterol in LDL particles from being taken up. Conversely, LDL receptor synthesis is promoted when a cell is deficient in cholesterol. When the process is unregulated, excess LDL particles will travel in the blood without uptake by an LDL receptor. LDL particles in the blood are oxidized and taken up by macrophages, which then become engorged and form foam cells. These foam cells can become trapped in the walls of blood vessels and contribute to atherosclerotic plaque formation, which is one of the main causes of heart attacks, strokes, and other serious medical problems.

The liver protein proprotein convertase subtilisin/kexin Type 9 (PCSK9) is a secreted, globular, auto-activating serine protease that binds to the low-density lipoprotein receptor (LDL-R) during endocytosis of LDL particles, preventing recycling of the LDL-R to the cell surface and leading to reduction of LDL-cholesterol clearance. PCSK9 binds to the LDL-R (through the EGF-A domain), preventing the conformational change of the receptor-ligand complex, which redirects the LDL-R to the lysosome instead. As the receptor for low-density lipoprotein particles (LDL) typically transports thousands of fat molecules (including cholesterol) per particle within extracellular fluid, blocking or inhibiting the function of PCSK9 to boost LDL-R-mediated clearance of LDL cholesterol can lower LDL particle concentrations. PCSK9 is expressed mainly in the liver, the intestine, the kidney, and the central nervous system, but is also highly expressed in arterial walls such as endothelium, smooth muscle cells, and macrophages, with a local effect that can regulate vascular homeostasis and atherosclerosis.

PCSK9 is a member of the proprotein convertase (PC) family and its gene is mutated in ~2% to 3% of individuals with familial hypercholesterolemia (FH) (Sepidch Mikaccli, S., et al. Functional analysis of natural PCSK9 mutants in modern and archaic humans. FEBS J. 2019 Aug. 6. doi: 10.1111/febs.15036). Researchers have identified several PCSK9 mutations that cause an inherited form of high cholesterol (hypercholesterolemia). These mutations change a single amino acid in the PCSK9 protein. Researchers describe the mutations responsible for hypercholesterolemia as “gain-of-function” because they appear to enhance the activity of the PCSK9 protein or give the protein a new, atypical function (Blesa, S., et al. A New PCSK9 Gene Promoter Variant Affects Gene Expression and Causes Autosomal Dominant Hypercholesterolemia. J. Clin. Endocrinol. & Metab. 93:3577(2008)). The overactive PCSK9 protein substantially reduces the number of low-density lipoprotein receptors on the surface of liver cells. With fewer receptors to remove low-density lipoproteins from the blood, people with gain-of-function mutations in the PCSK9 gene have very high blood cholesterol levels. Autosomal dominant hypercholesterolemia (ADH) is a genetic disorder characterized by increased low-density lipoprotein (LDL)-cholesterol levels, leading to high risk of premature cardiovascular disease. Approximately 10 mutations in PCSK9 have been identified as a cause of the disease in different populations. All known mutations in PCSK9 causing hypercholesterolemia produce an increase in the enzymatic activity of this protease (Bleasa, S., 2008). In addition, mutations in PCSK9 can lead to autosomal dominant familial hypobetalipoproteinemia, which can lead to hepatic steatosis, cirrhosis, and other disorders.

The advent of CRISPR/Cas systems, and the programmable nature of these minimal systems, has facilitated their use as a versatile technology for genomic manipulation and engineering. However, current methods of generating PCSK9 protective variants and loss-of-function mutants in vivo have been ineffective due to the large number of cells that need to be modified to modulate cholesterol levels. Other concerns involve off-target effects, genome instability, or oncogenic modifications that may be caused by genome editing, as well as a lack of safe delivery modalities for gene-repression systems. Additionally, in certain disease indications, gene silencing, or repression, is preferable to gene editing. The ability to render CRISPR nucleases such as Cas9 and CasX catalytically-inactive has been demonstrated (WO2020247882A1 and US20200087641A1, incorporated by reference herein), which makes these systems an attractive platform for the generation of fusion proteins with repressor domains capable of gene silencing. While certain repressor systems have been described, there remains a need for additional gene repressor systems that have been optimized and/or offer improvements over earlier generations of gene repressor systems, such as those based on Cas9, for utilization in a variety of therapeutic, diagnostic, and research applications. Thus, there remains a need for improved compositions and methods to regulate PCSK9.

SUMMARY

The present disclosure provides systems comprising or encoding repressor fusion proteins comprising DNA-binding and linked repressor domains used in the repression and/or epigenetic modification of proprotein convertase subtilisin/kexin Type 9 (PCSK9) gene target nucleic acid sequences. In some cases, the repressor fusion protein comprises a DNA-binding protein comprising a zinc finger (ZF) or a transcription-activator-like effector (TALE) protein complementary to the PCSK9 gene target nucleic acid sequence and one or more linked repressor domains. In some cases, the repressor fusion protein comprises a DNA-binding protein comprising a catalytically-dead CRISPR protein and one or more linked repressor domains, and a guide nucleic acid comprising a targeting sequence complementary to the PCSK9 gene target nucleic acid sequence. The proteins and guide nucleic acids can be modified for passive entry into target cells and are useful in a variety of methods for repression of PCSK9, which methods are also provided. The present disclosure also provides vectors and lipid nanoparticles (LNP) encoding or encapsulating the repressor fusion proteins and guide nucleic acids components for the delivery of the systems to cells for the transcriptional repression of the PCSK9 target nucleic acid sequence.

The disclosure provides pharmaceutical compositions comprising the systems, nucleic acids, LNP and vectors described herein.

The present disclosure also provides methods for treating subjects having a PCSK9-related disease. In some embodiments, the compositions and methods have utility in subjects having a metabolic disorder such as, but not limited to, familial hypercholesterolemia, familial hypobetalipoproteinemia, or elevated cholesterol levels.

In another aspect, provided herein are systems comprising PCRK9 repressor systems, or vectors comprising or encoding PCSK9 repressor systems for use in the manufacture of a medicament for the treatment of a PCSK9-related disease in a subject in need thereof.

The present disclosure provides compositions for use in methods of treating subjects having a PCSK9-related disease. In some embodiments, the composition comprises repressor fusion proteins comprising a catalytically-dead CRISPR protein and one or more linked repressor domains, and a guide nucleic acid comprising a targeting sequence complementary to the PCSK9 gene target nucleic acid sequence for use in the transcriptional repression of PCSK9 gene target nucleic acid sequences in a subject. In some embodiments, the composition comprises systems, nucleic acids, LNP, vectors and/or pharmaceutical compositions described herein.

In some embodiments, the PCSK9 gene comprises one or more mutations, for example amino acid substitutions selected from the group consisting of S127R, D129G, F216L, D374H, and D374Y relative to the sequence of SEQ ID NO: 1823.

The disclosure provides methods of repressing transcription of a PCSK9 gene in a population of cells, the method comprising introducing into cells of the population the systems, nucleic acids, LNP, vectors and/or pharmaceutical compositions described herein.

In some embodiments, the catalytically-dead CRISPR protein and guide nucleic acid for use in the PCSK9 repressor systems comprise catalytically-dead CasX variant proteins and/or CasX variant guide nucleic acids as described herein.

Further features and advantages of certain embodiments of the present disclosure will become more fully apparent in the following description of embodiments and drawings thereof, and from the claims.

BRIEF DESCRIPTION OF THE DRAWINGS

The novel features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings of which:

Figure 39:
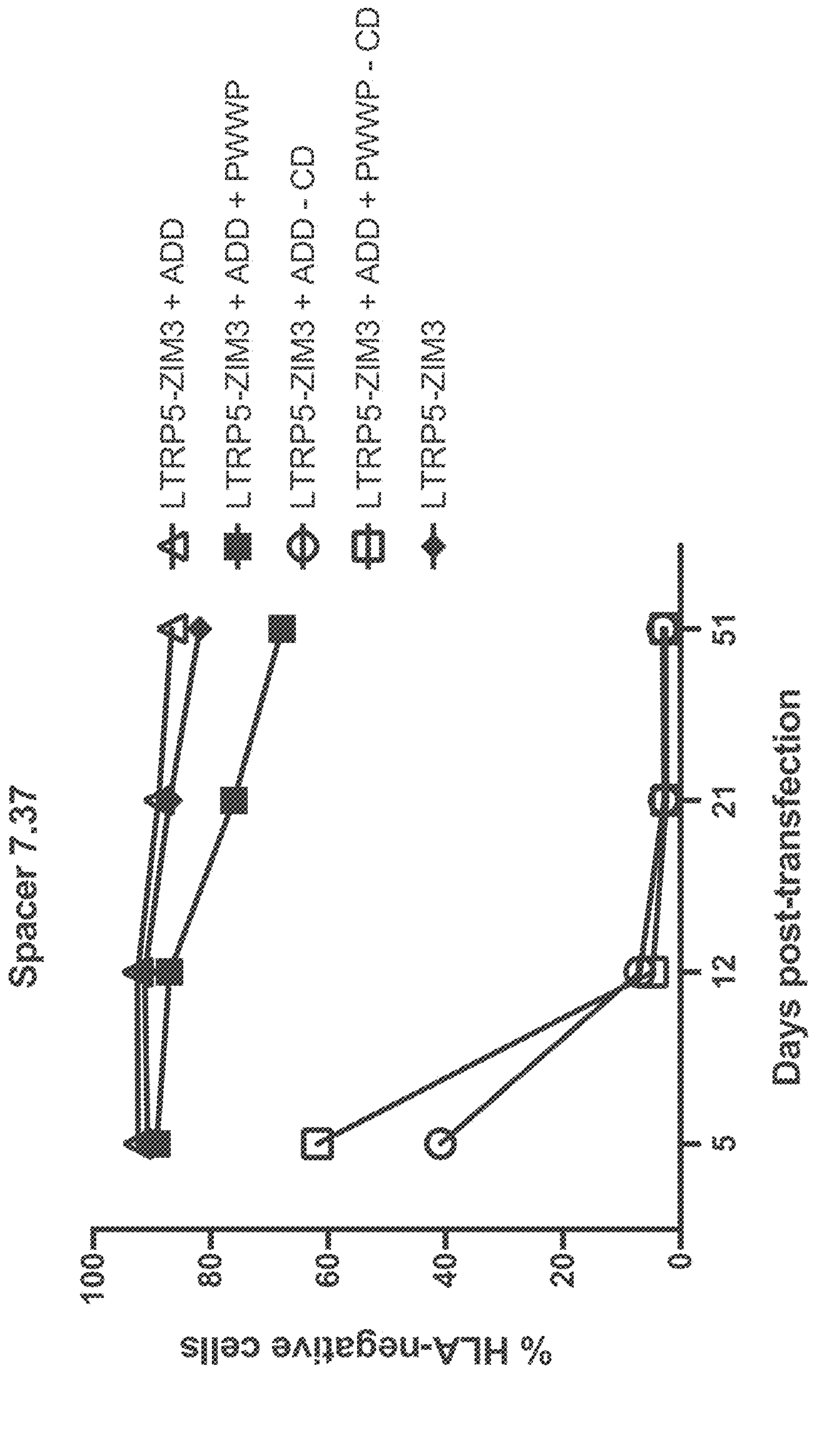
FIG. 39 presents the results of a time-course experiment comparing B2M repression activities (represented as percentage of HLA-negative cells) of the indicated LTRP-ZIM3 and its variants with B2M-targeting gRNA using spacer 7.37, as described in Example 14. Data are presented as mean with standard deviation, N=3. CD=catalytic domain of DNMT3A.
Figure 40:
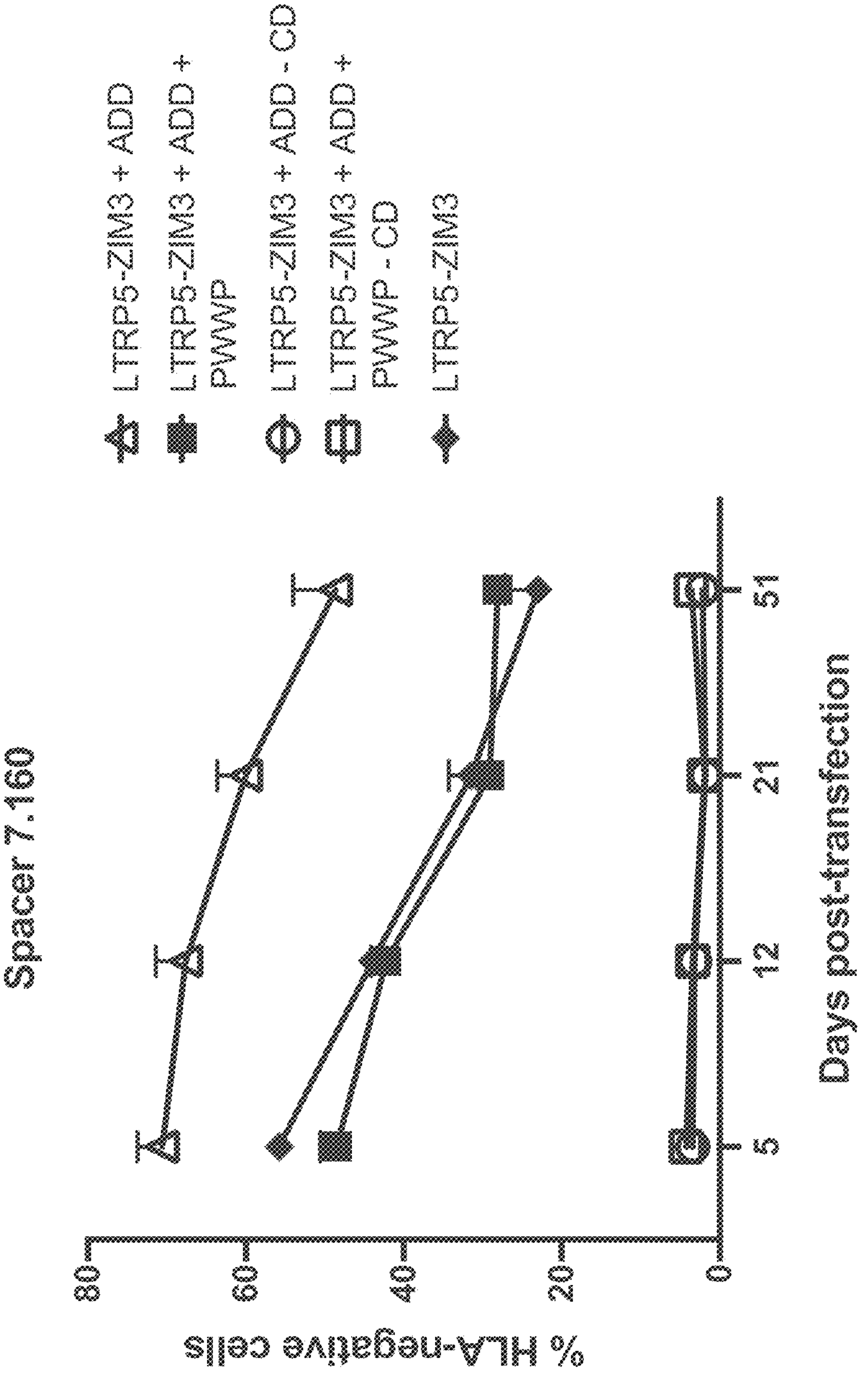

FIG. 40 presents the results of the same time-course experiment shown in FIG. 39 but shows B2M repression activities of the indicated LTRP-ZIM3 variants with B2M-targeting gRNA using spacer 7.160, as described in Example 14. Data are presented as mean with standard deviation, N=3.

Figure 41:
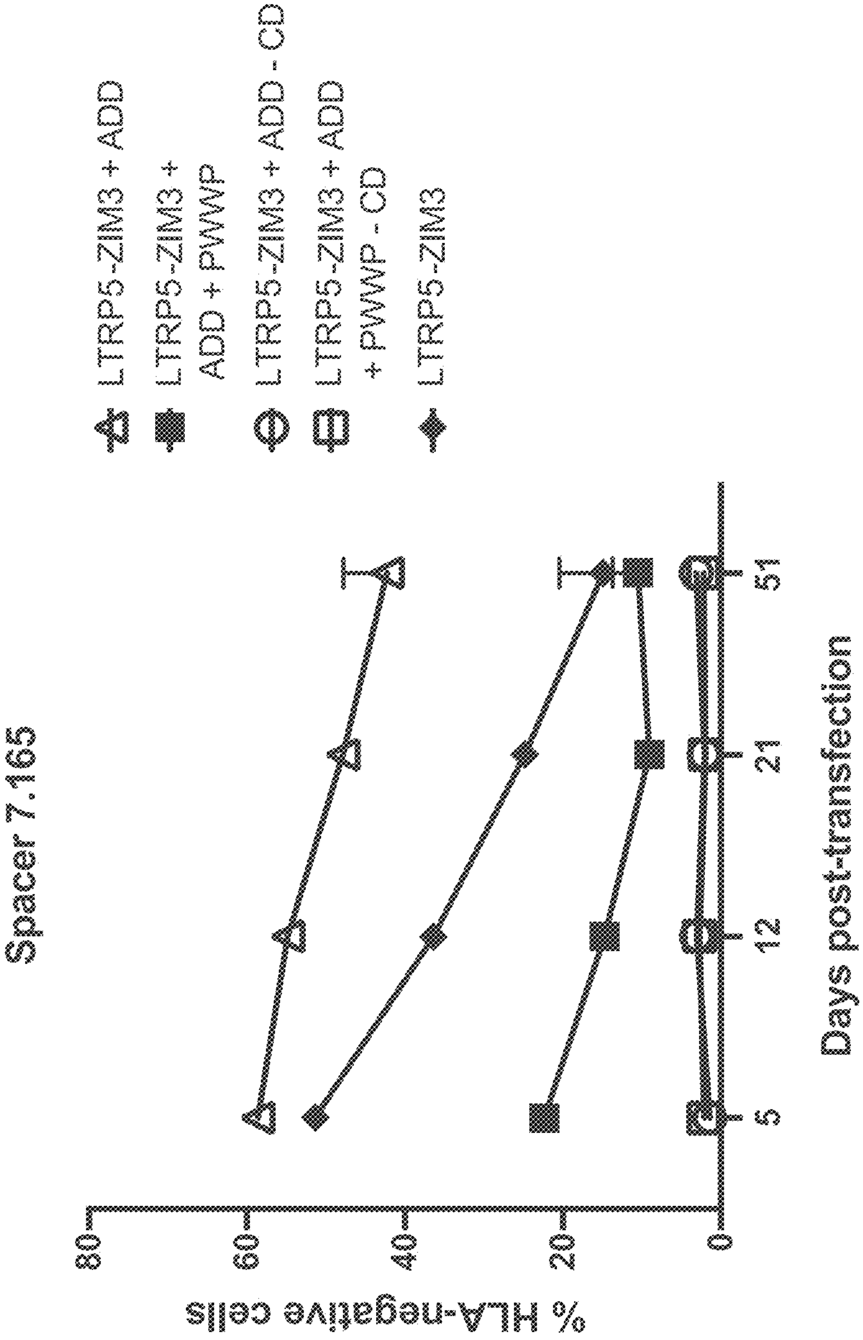

FIG. 41 presents the results of the same time-course experiment shown in FIG. 39 but shows B2M repression activities of the indicated LTRP-ZIM3 variants with B2M-targeting gRNA using spacer 7.165, as described in Example 14. Data are presented as mean with standard deviation, N=3.

Figure 42:
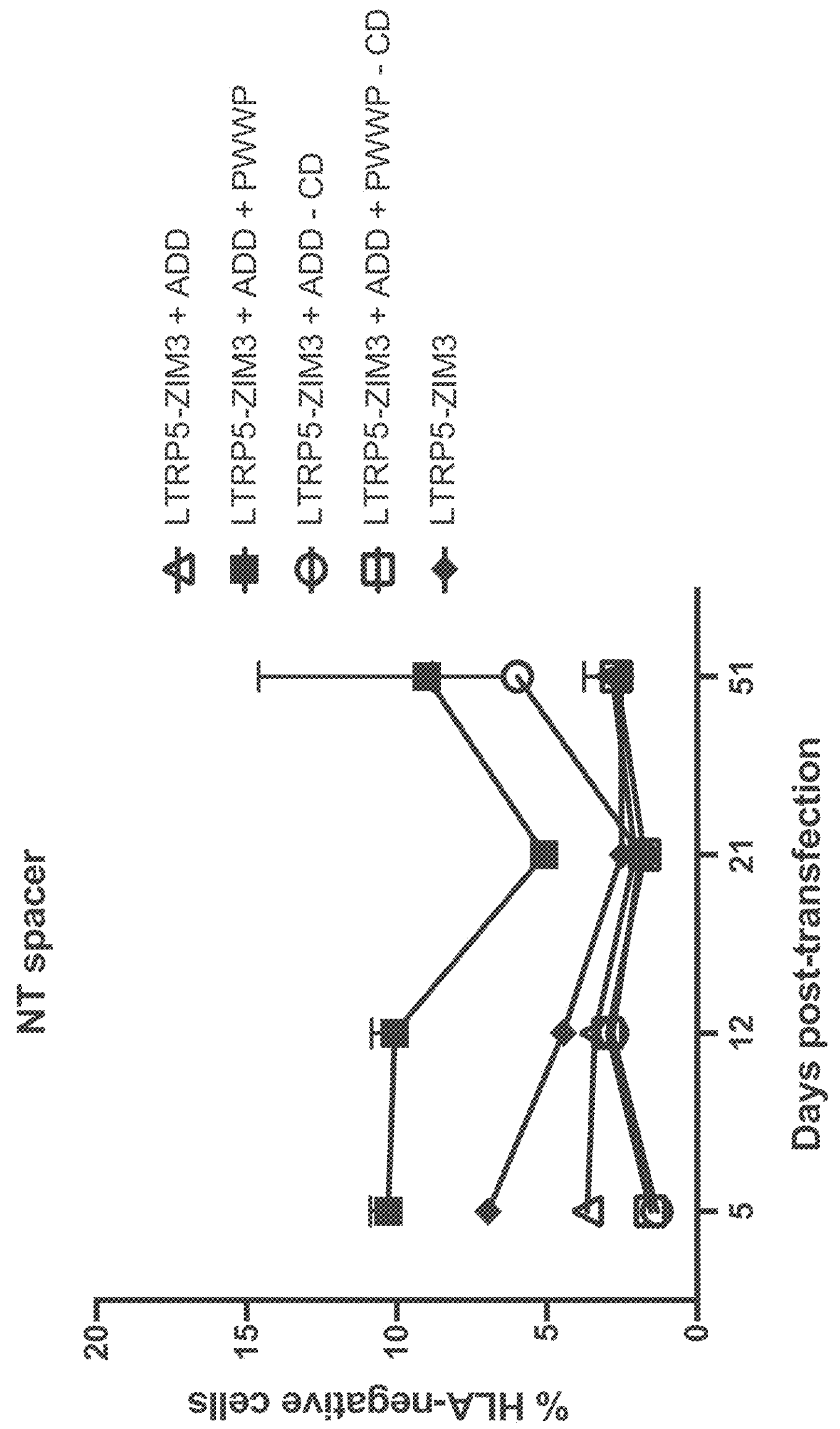

FIG. 42 presents the results of the same time-course experiment shown in FIG. 39 but shows B2M repression activities of the indicated LTRP-ZIM3 variants with a non-targeting gRNA, as described in Example 14. Data are presented as mean with standard deviation, N=3.

Figure 43:
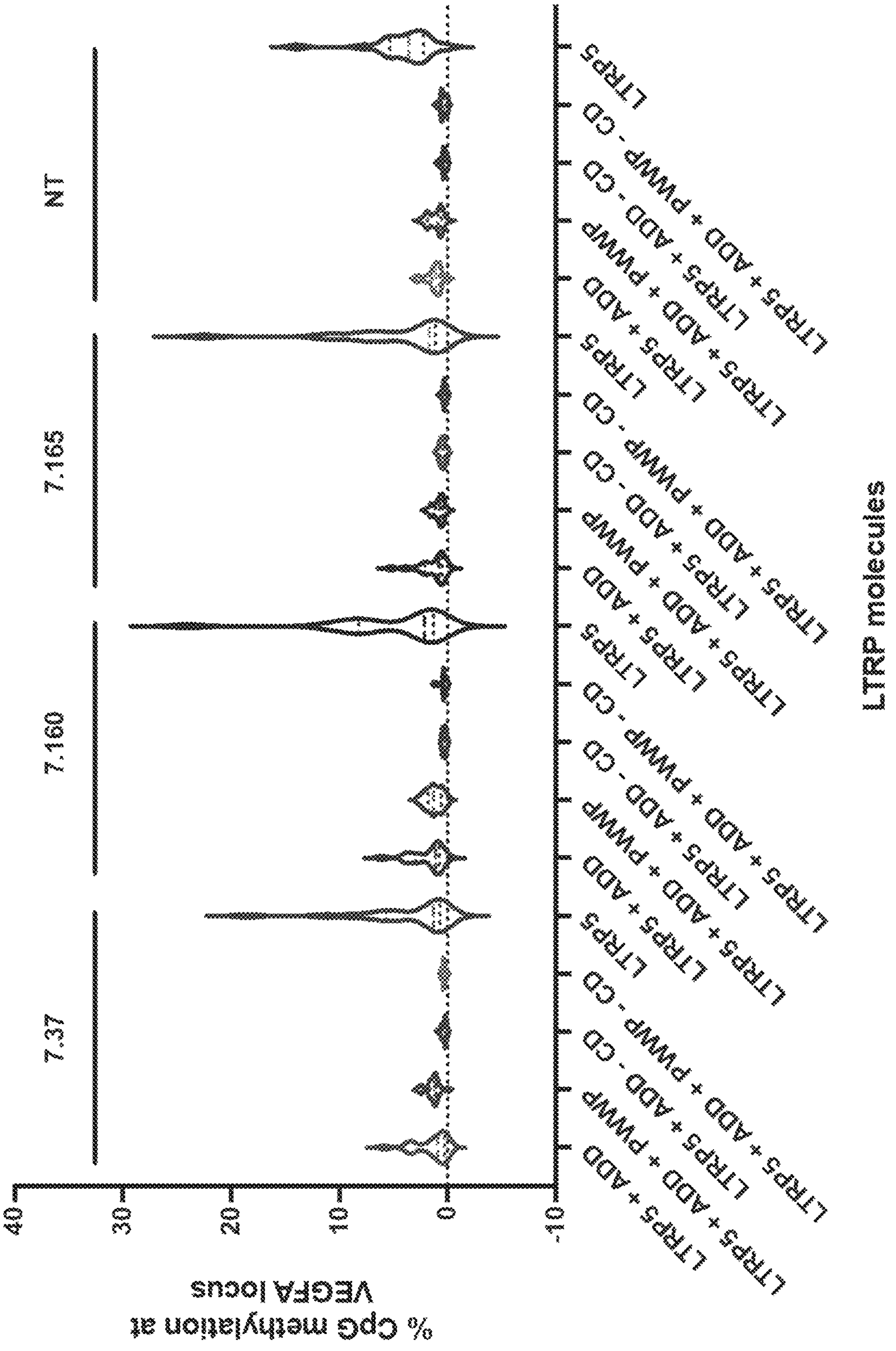

FIG. 43 is a violin plot of percent CpG methylation for CpG sites downstream of the transcription start site of the VEGFA locus for each indicated LTRP-ZIM3 variant for the three B2M-targeting gRNA and non-targeting gRNA, as described in Example 14.

Figure 44:
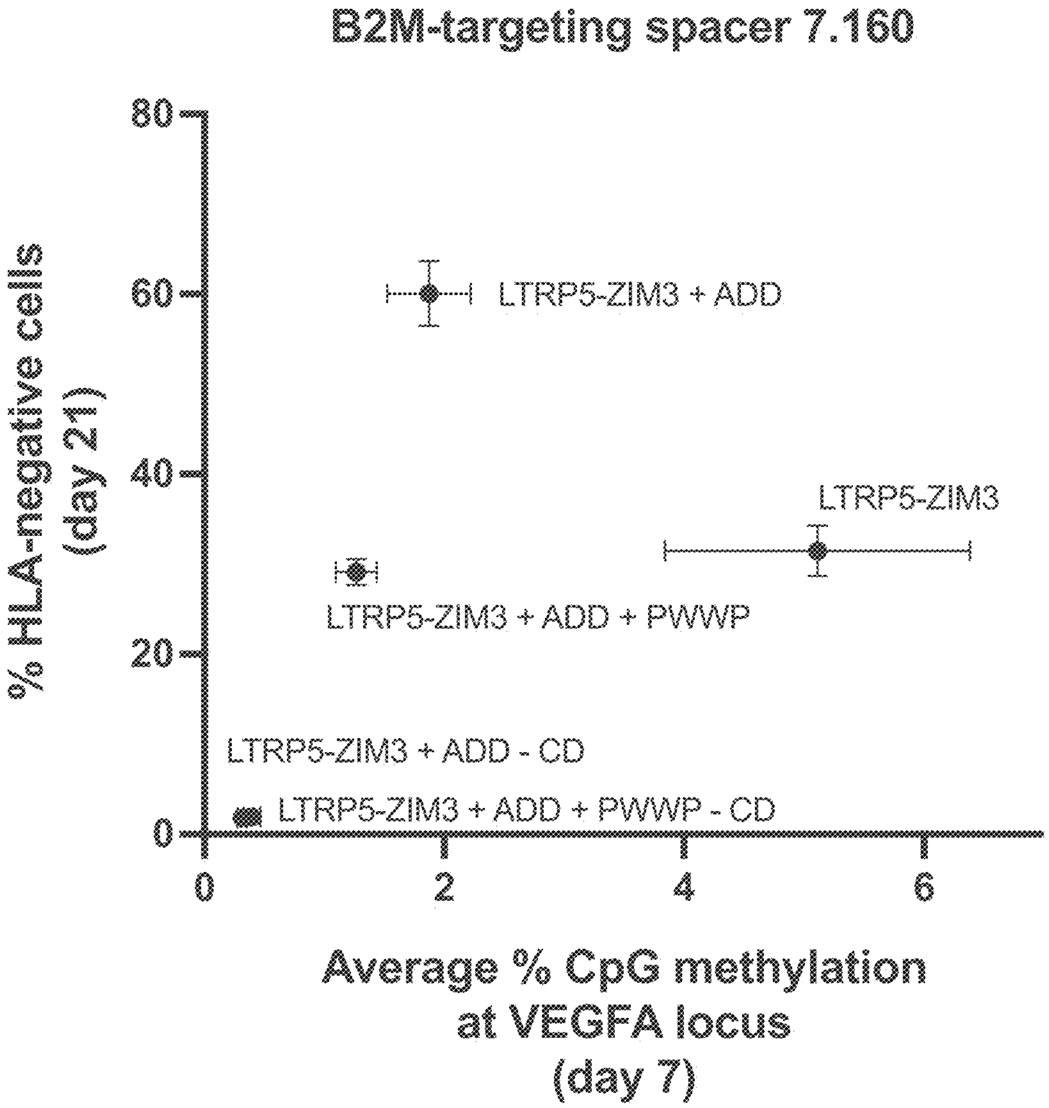

FIG. 44 is a scatterplot showing the relative activity (average percentage of HLA-negative cells at day 21 for spacer 7.160) versus specificity (percentage of off-target CpG methylation at the VEGFA locus quantified at day 7 for spacer 7.160) for the indicated LTRP5-ZIM3 variants, as described in Example 14.

Figure 45:
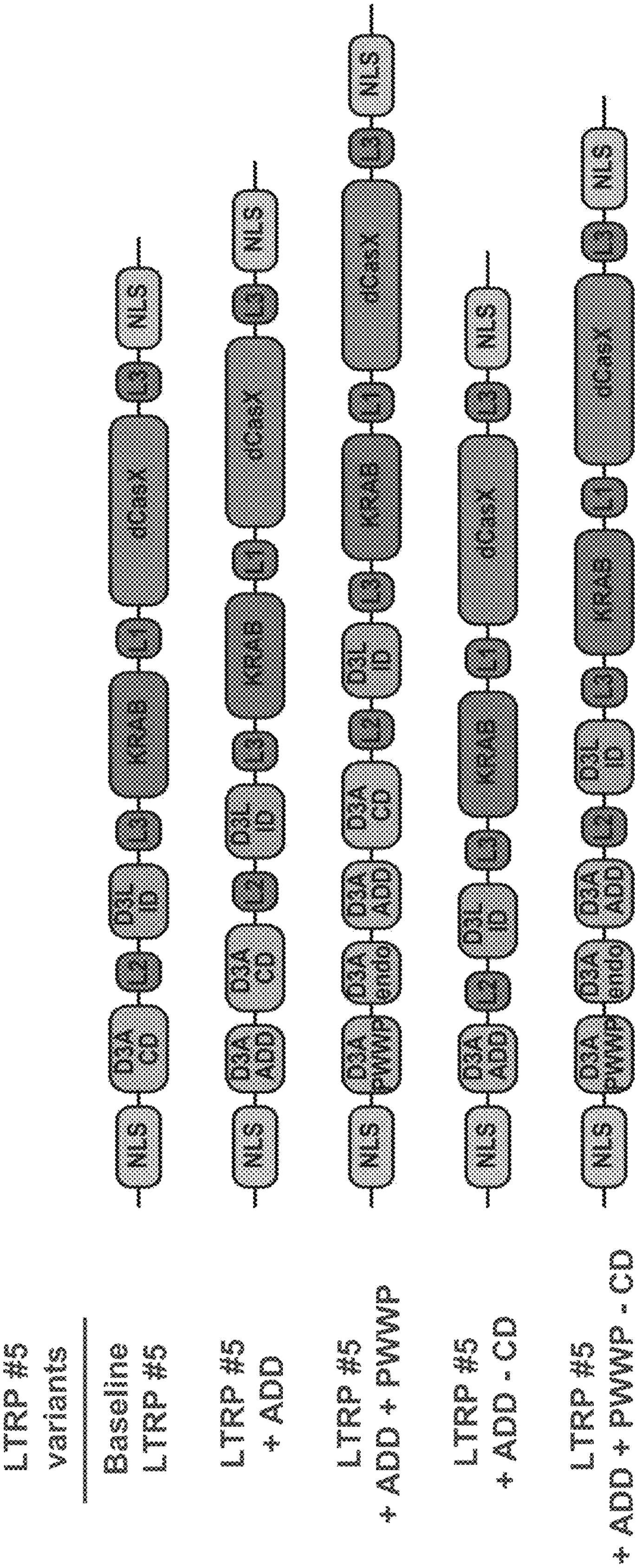

FIG. 45 illustrates the schematics of the various LTRP #5 architectures, where the additional DNMT3A domains were incorporated, as described in Example 14. The additional DNMT3A domains were the ADD domain of DNMT3A ("D3A ADD") and the PWWP domain of DNMT3A ("D3A PWWP"). "D3A endo" encodes for an endogenous sequence that occurs between DNMT3A PWWP and ADD domains. "D3A CD" and "D3L ID" denote the catalytic domain of DNMT3A and the interaction domain of DNMT3L respectively. "L1-L3" are linkers. "NLS" is the nuclear localization signal. See Table 12 for exemplary sequences.

Figure 46:
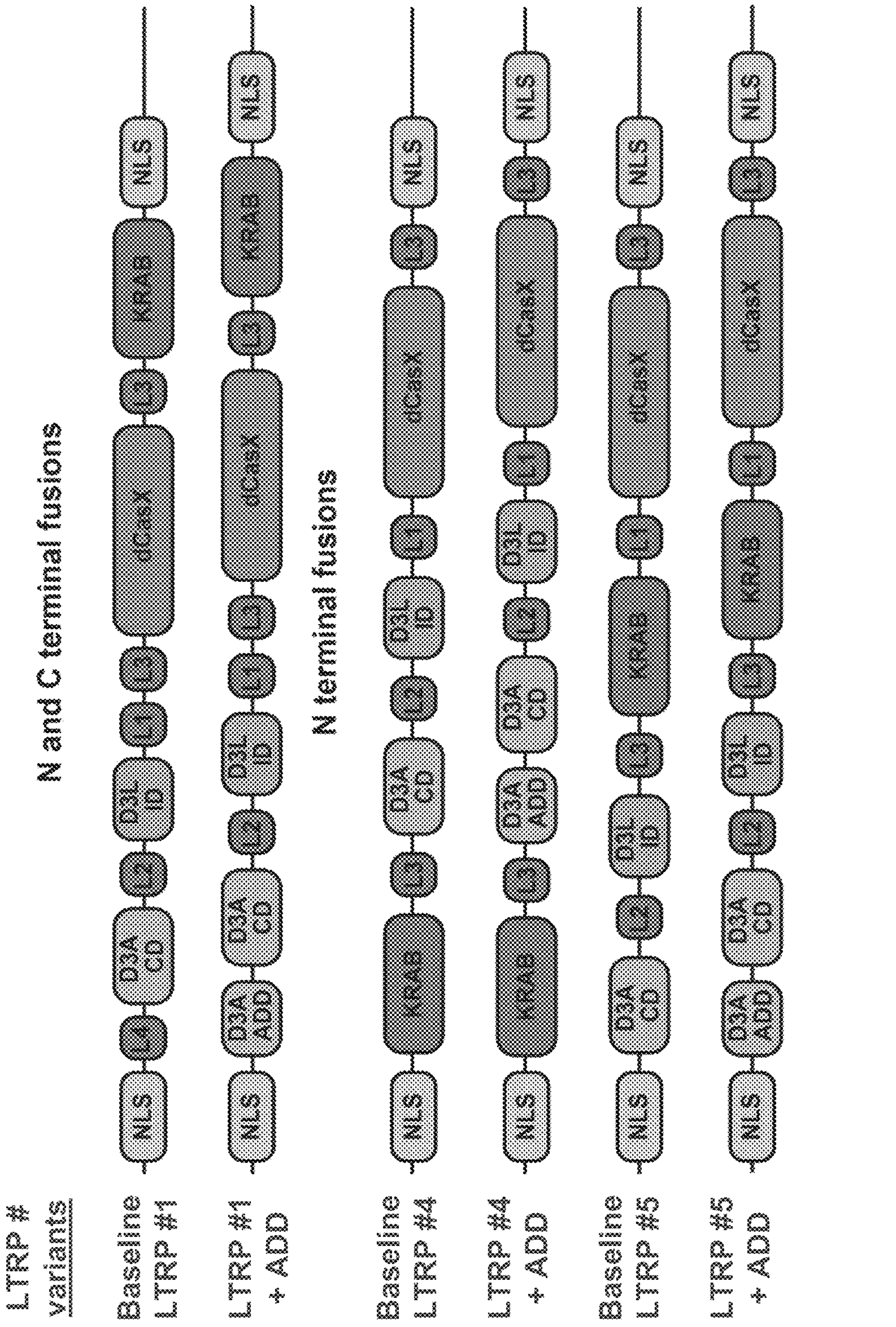

FIG. 46 illustrates the schematics of the general architectures of the LTRP molecules with the ADD domain for LTRP configuration #1, #4, and #5 tested in Example 15. "D3A ADD", "D3A CD" and "D3L ID" denote the ADD domain of DNMT3A, the catalytic domain of DNMT3A, and the interaction domain of DNMT3L respectively, as described in Example 15. "L1-L4" are linkers. "NLS" is the nuclear localization signal. See Table 17 for exemplary sequences.

Figure 47A:
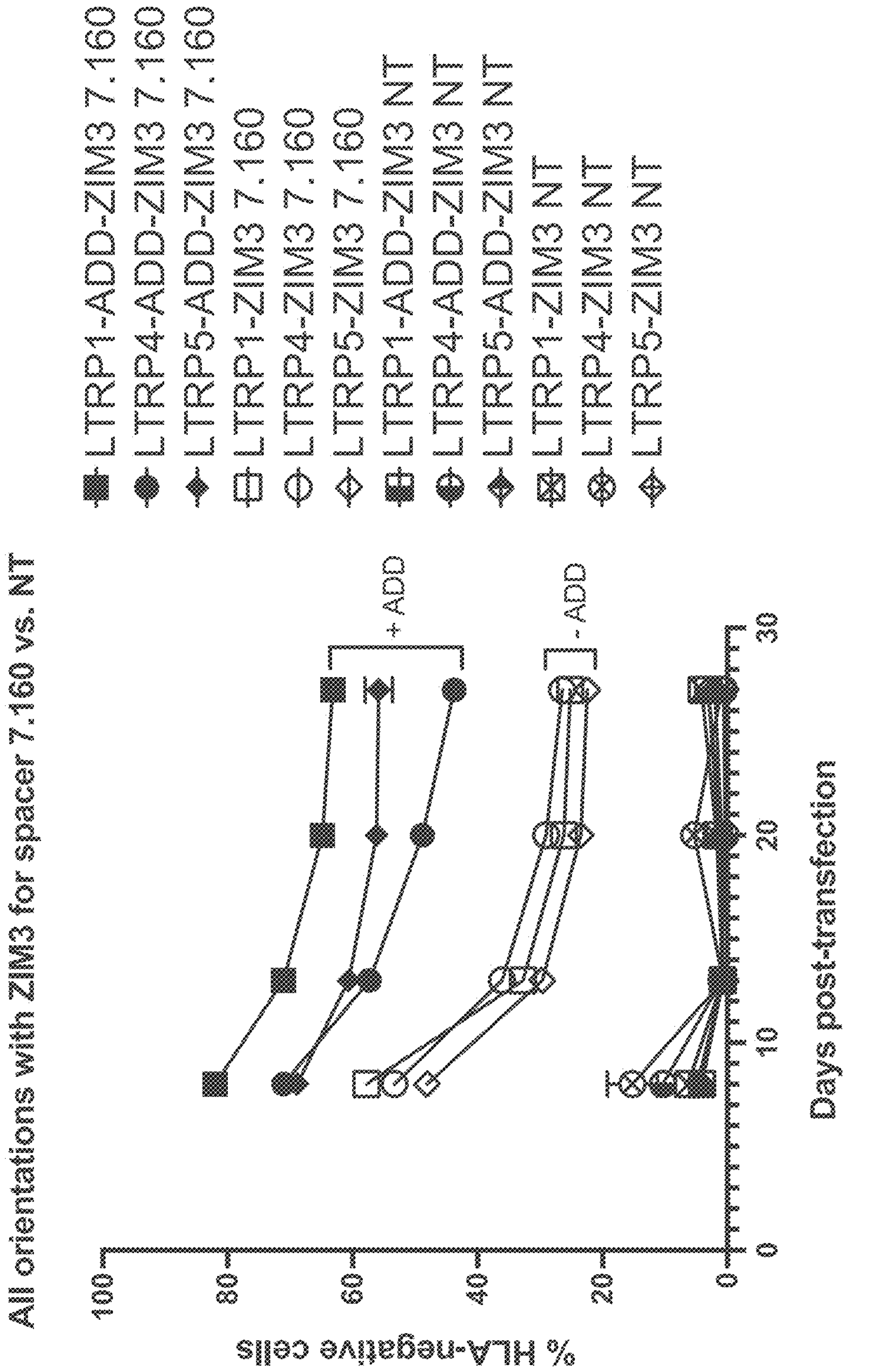

FIG. 47A presents the results of a time-course experiment comparing B2M repression activities (represented as percentage of HLA-negative cells) of LTRPs with the ZIM3-KRAB domain having configuration #1, #4, or #5 with or without the DNMT3A ADD domain when paired with the B2M-targeting gRNA with spacer 7.160, as described in Example 15. Data are presented as mean with standard deviation, N=3. "NT" is a gRNA with a non-targeting spacer.

Figure 47B:
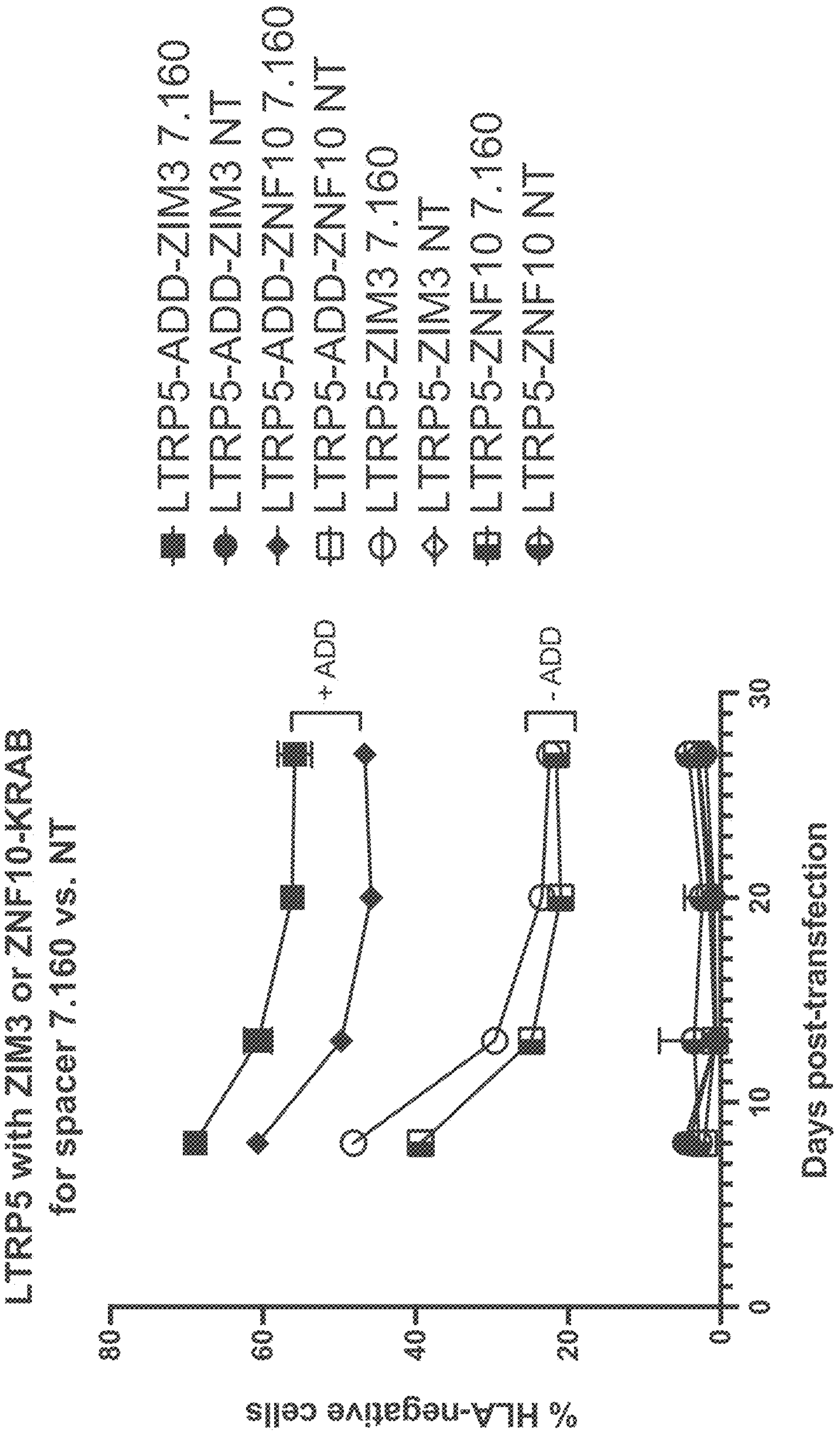

FIG. 47B is a plot showing the results of the same time-course experiment shown in FIG. 47A but illustrates B2M repression activities for LTRP #5 with the ZNF10 or ZIM3-KRAB domain, with or without the DNMT3A ADD domain, paired with the B2M-targeting gRNA with spacer 7.160, as described in Example 15. Data are presented as mean with standard deviation, N=3. "NT" is a gRNA with a non-targeting spacer.

Figure 47C:
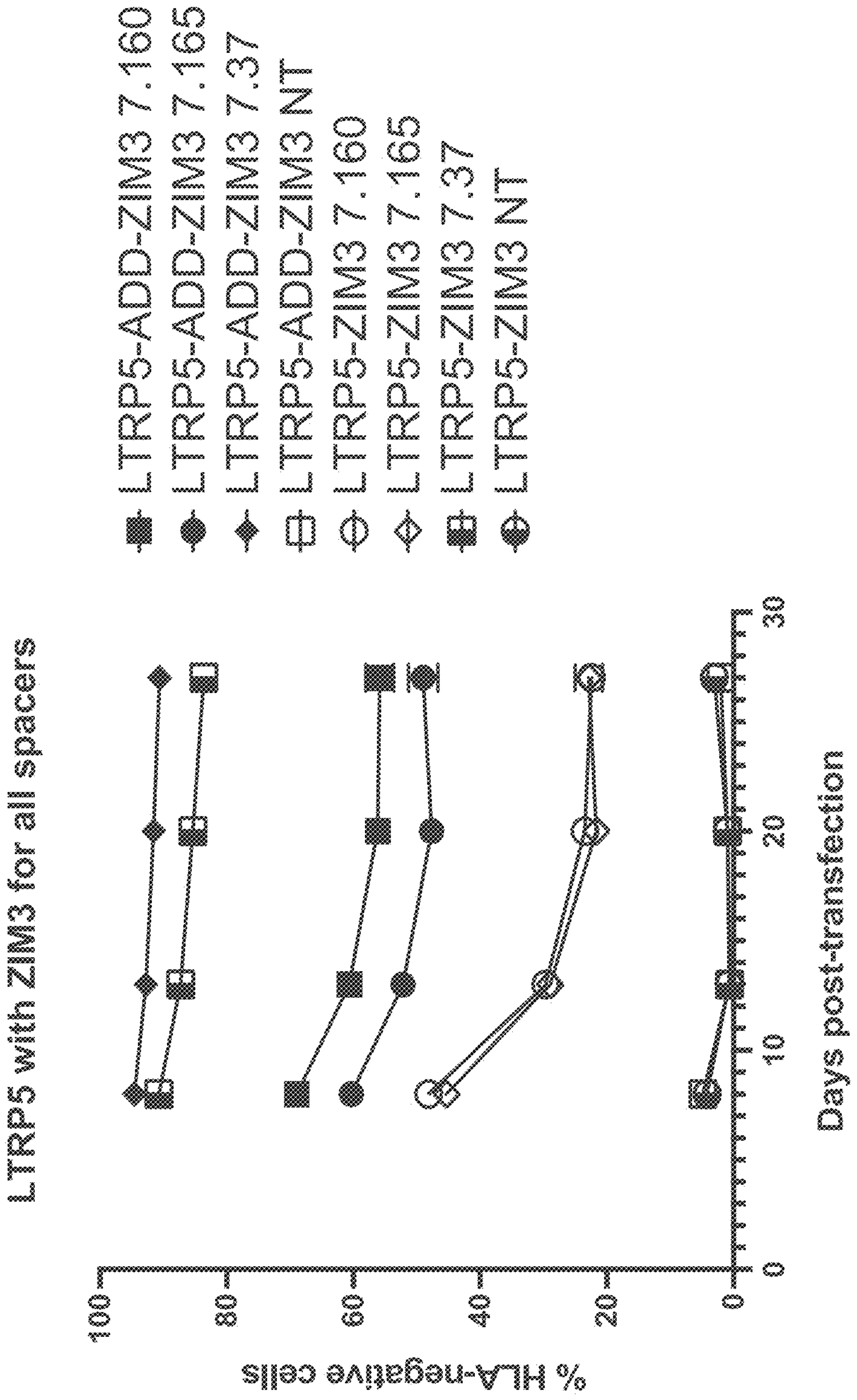

FIG. 47C is a plot showing the results of the same time-course experiment shown in FIG. 47A but illustrates B2M repression activities for LTRP5-ZIM3 with or without the DNMT3A ADD domain paired with a B2M-targeting gRNA with the indicated spacers, as described in Example 15. Data are presented as mean with standard deviation, N=3. "NT" is a gRNA with a non-targeting spacer.

Figure 48A:
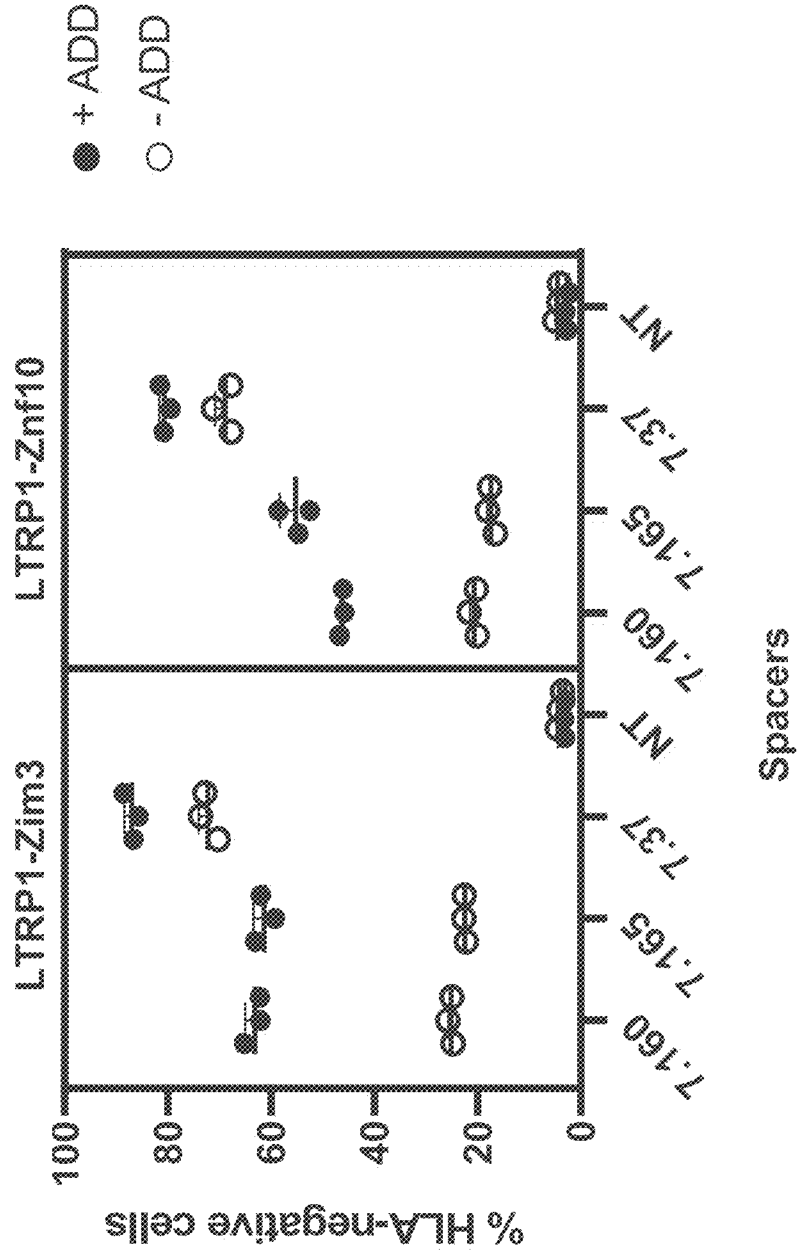

FIG. 48A is a plot illustrating the results of B2M repression activities on day 27 post-transfection for LTRPs with either the ZNF10 or ZIM3-KRAB domain having configuration #1 with or without the DNMT3A ADD domain for the indicated gRNAs, as described in Example 15. Data are presented as mean with standard deviation, N=3. "NT" is a gRNA with a non-targeting spacer.

Figure 48B:
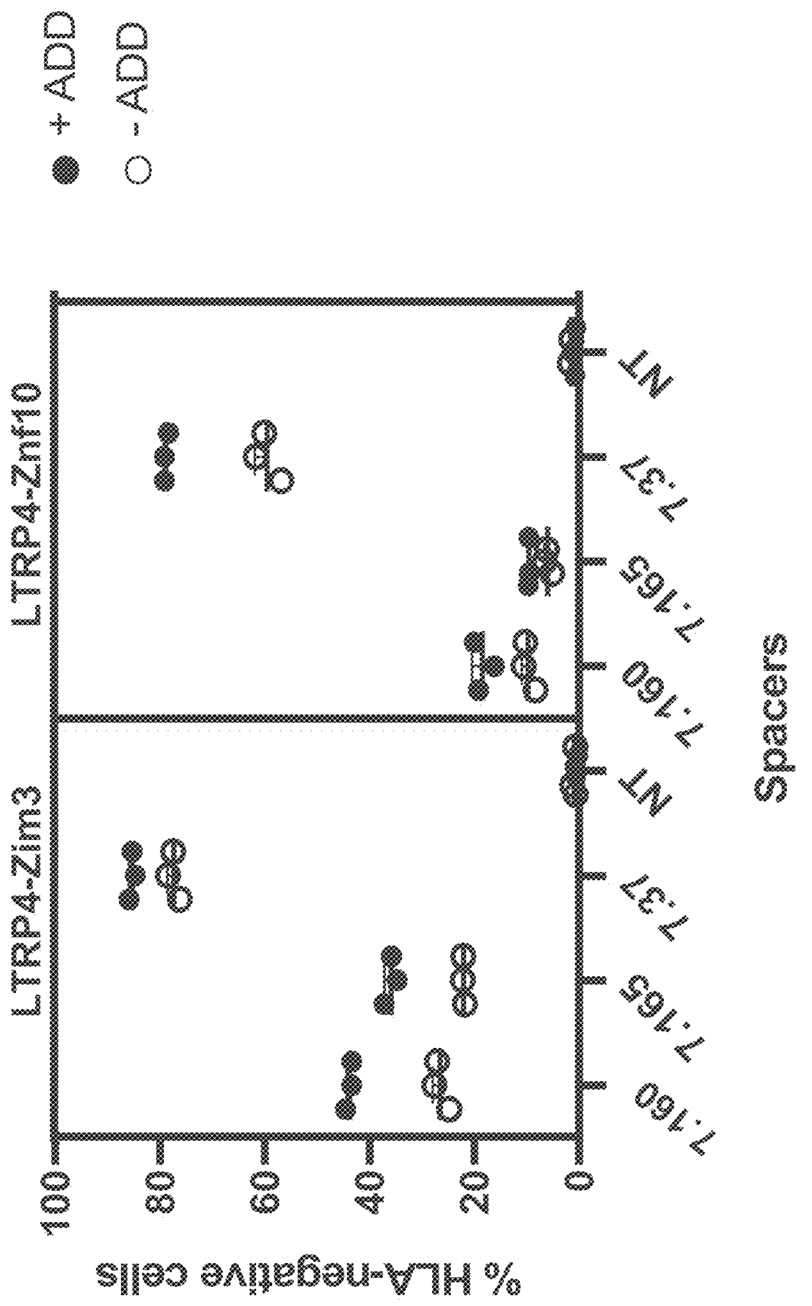

FIG. 48B is a plot illustrating the results of B2M repression activities on day 27 post-transfection for LTRPs with either the ZNF10 or ZIM3-KRAB domain having configuration #4 with or without the DNMT3A ADD domain for the indicated gRNAs, as described in Example 15. Data are presented as mean with standard deviation, N=3. "NT" is a gRNA with a non-targeting spacer.

Figure 48C:
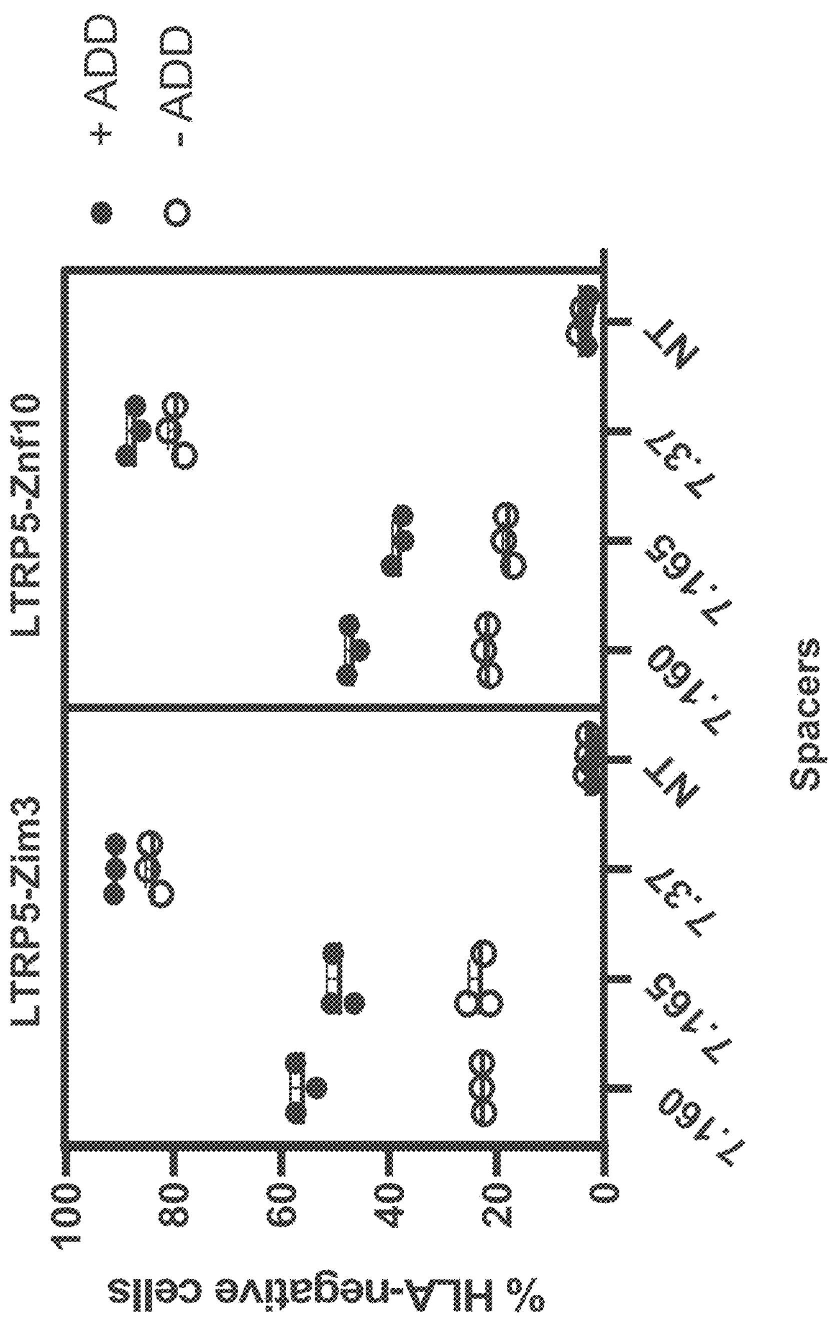

FIG. 48C is a plot illustrating the results of B2M repression activities on day 27 post-transfection for LTRPs with either the ZNF10 or ZIM3-KRAB domain having configuration #5 with or without the DNMT3A ADD domain for the indicated gRNAs, as described in Example 15. Data are presented as mean with standard deviation, N=3. "NT" is a gRNA with a non-targeting spacer.

Figure 49A:
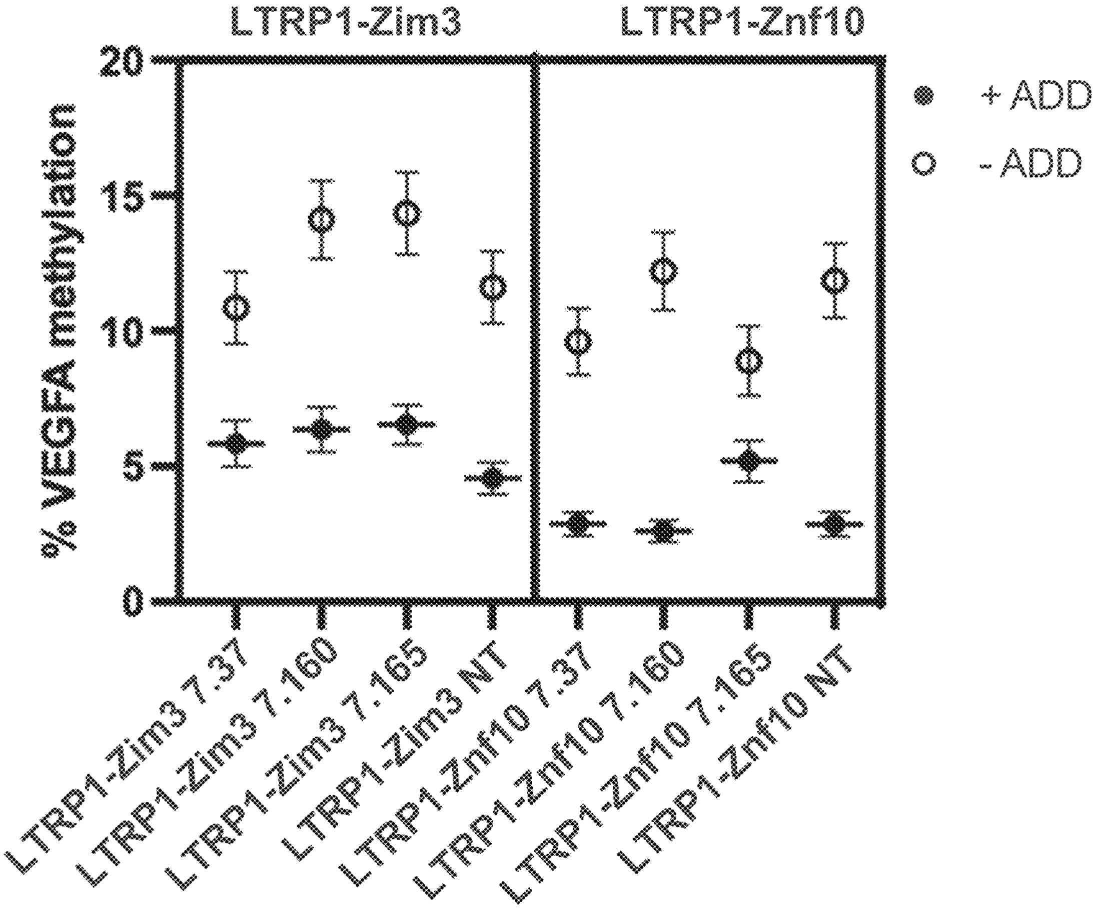

FIG. 49A is a plot illustrating the results of bisulfite sequencing used to determine off-target methylation at the VEGFA locus on day 5 post-transfection for LTRPs with either the ZNF10 or ZIM3-KRAB domain having configuration #1 with or without the DNMT3A ADD domain for the indicated gRNAs, as described in Example 15. Data are presented as mean percentage of CpG methylation for CpG sites near the VEGFA locus; standard error of the mean is also presented; N=3. "NT" is a gRNA with a non-targeting spacer.

Figure 49B:
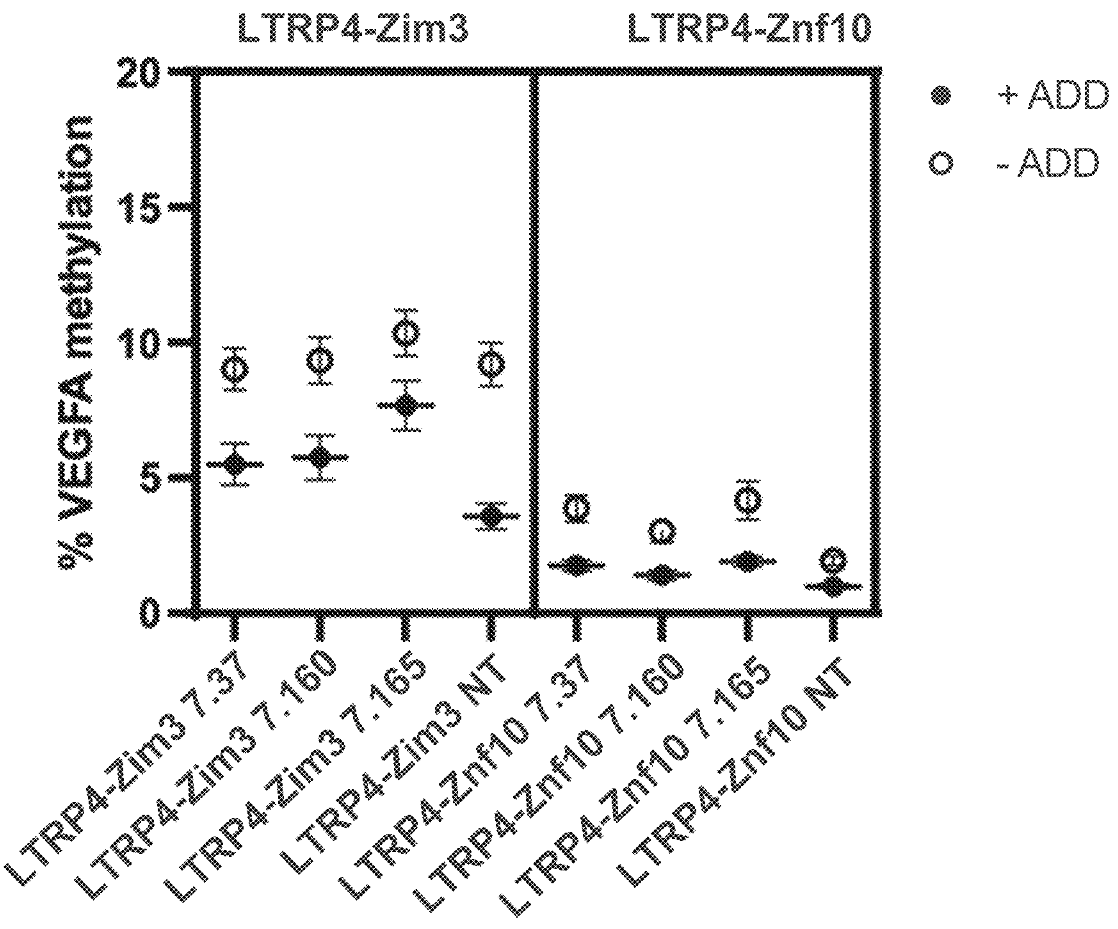

FIG. 49B is a plot illustrating the results of bisulfite sequencing used to determine off-target methylation at the VEGFA locus on day 5 post-transfection for LTRPs with either the ZNF10 or ZIM3-KRAB domain having configuration #4 with or without the DNMT3A ADD domain for the indicated gRNAs, as described in Example 15. Data are presented as mean percentage of CpG methylation for CpG sites near the VEGFA locus; standard error of the mean is also presented; N=3. "NT" is a gRNA with a non-targeting spacer.

Figure 49C:
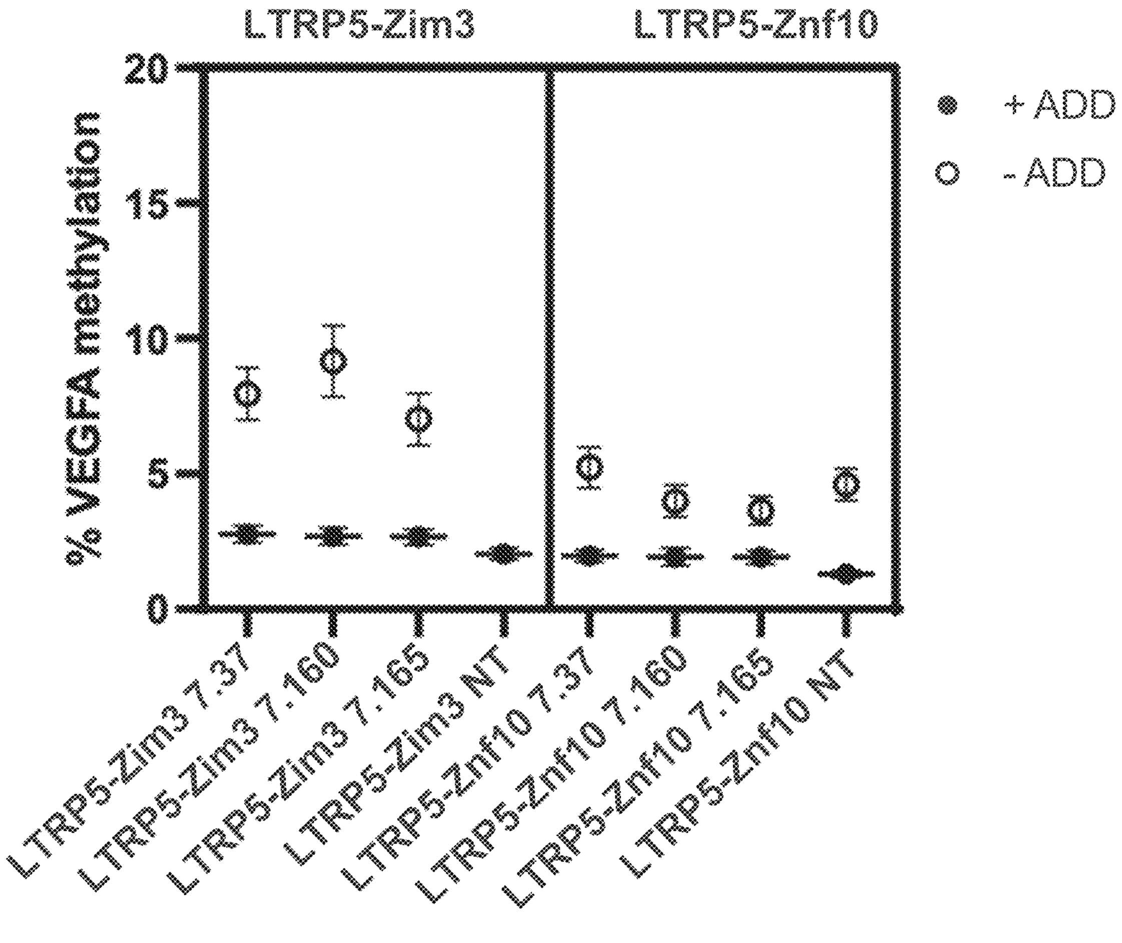

FIG. 49C is a plot illustrating the results of bisulfite sequencing used to determine off-target methylation at the VEGFA locus on day 5 post-transfection for LTRPs with either the ZNF10 or ZIM3-KRAB domain having configuration #5 with or without the DNMT3A ADD domain for the indicated gRNAs, as described in Example 15. Data are presented as mean percentage of CpG methylation for CpG sites near the VEGFA locus; standard error of the mean is also presented; N=3. "NT" is a gRNA with a non-targeting spacer.

Figure 50A:
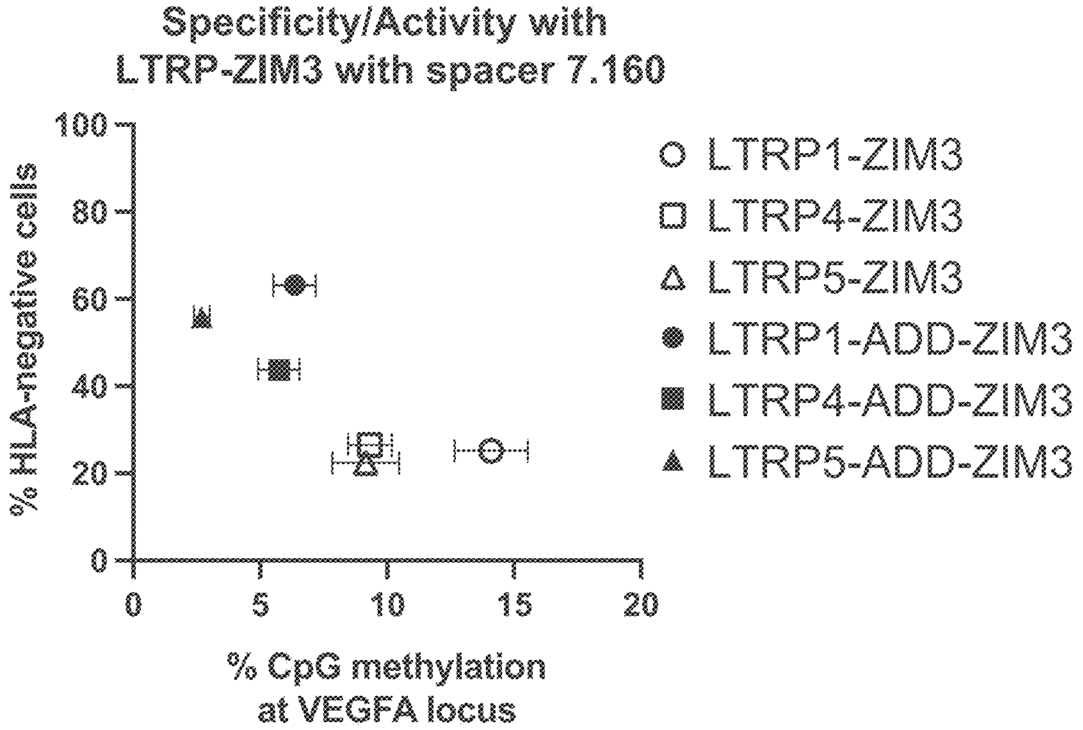

FIG. 50A is a dot plot showing the relative activity (average percentage of HLA-negative cells at day 27) versus specificity (percentage of off-target CpG methylation at the VEGFA locus quantified at day 5) for the LTRP molecules with the ZIM3-KRAB domain having configurations #1, #4, and #5, for B2M-targeting gRNA with spacer 7.160, as described in Example 15.

Figure 50B:
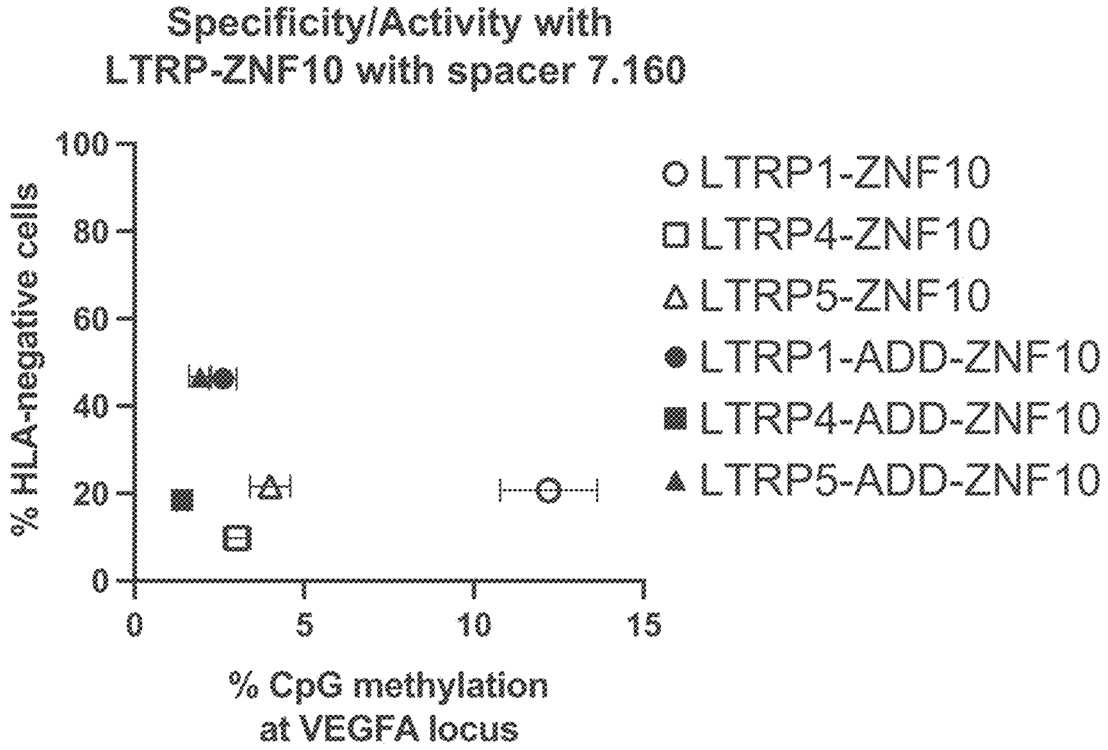

FIG. 50B is a dot plot showing the relative activity (average percentage of HLA-negative cells at day 27) versus specificity (percentage of off-target CpG methylation at the VEGFA locus quantified at day 5) for the LTRP molecules with the ZNF10-KRAB domain having configurations #1, #4, and #5, for B2M-targeting gRNA with spacer 7.160, as described in Example 15.

Figure 51A:
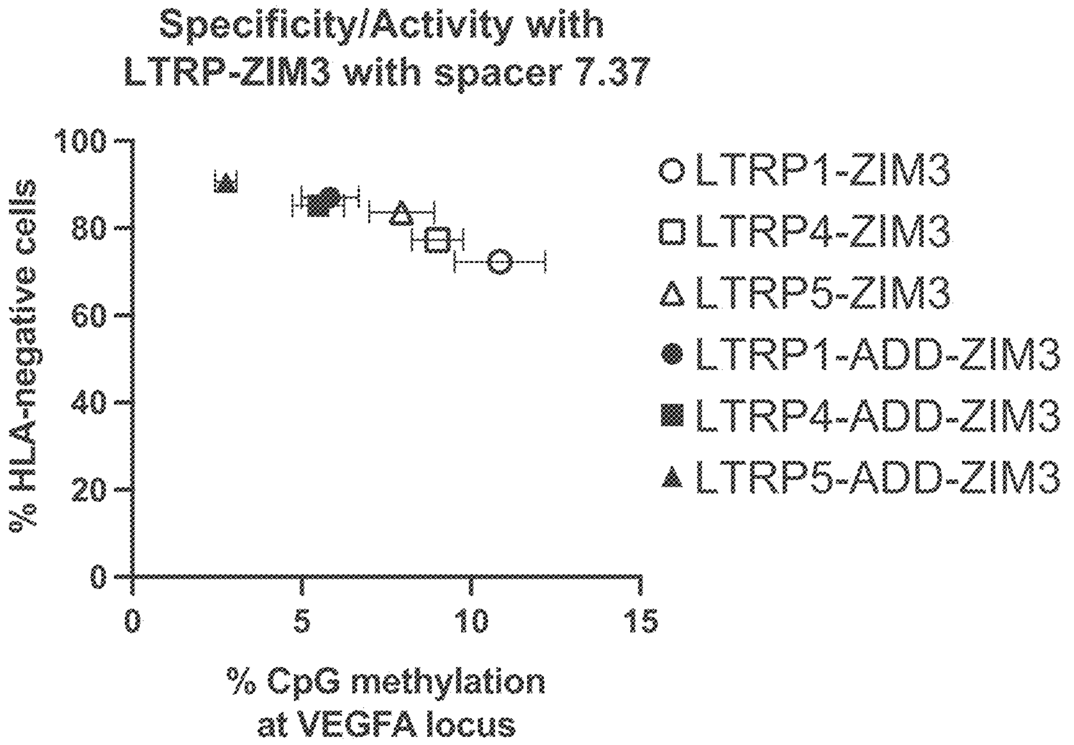

FIG. 51A is a dot plot showing the relative activity (average percentage of HLA-negative cells at day 27) versus specificity (percentage of off-target CpG methylation at the VEGFA locus quantified at day 5) for the LTRP molecules with the ZIM3-KRAB domain having configurations #1, #4, and #5, for B2M-targeting gRNA with spacer 7.37, as described in Example 15.

Figure 51B:
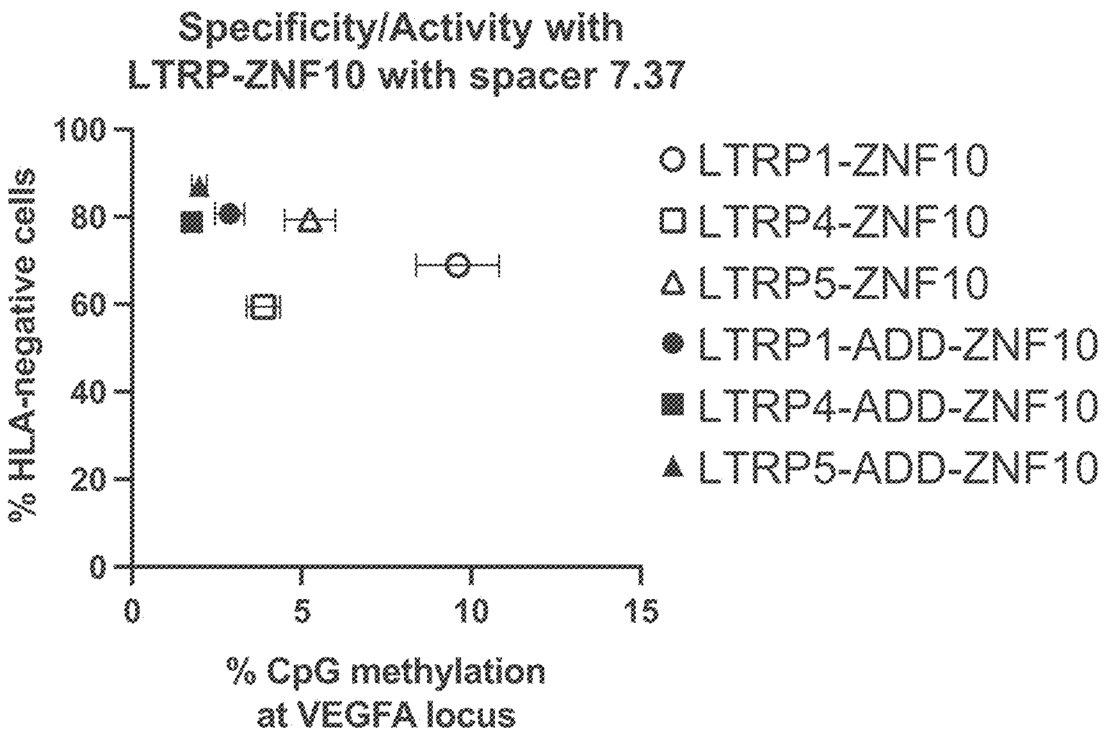

FIG. 51B is a dot plot showing the relative activity (average percentage of HLA-negative cells at day 27) versus specificity (percentage of off-target CpG methylation at the VEGFA locus quantified at day 5) for the LTRP molecules with the ZNF10-KRAB domain having configurations #1, #4, and #5, for B2M-targeting gRNA with spacer 7.37, as described in Example 15.

Figure 52A:
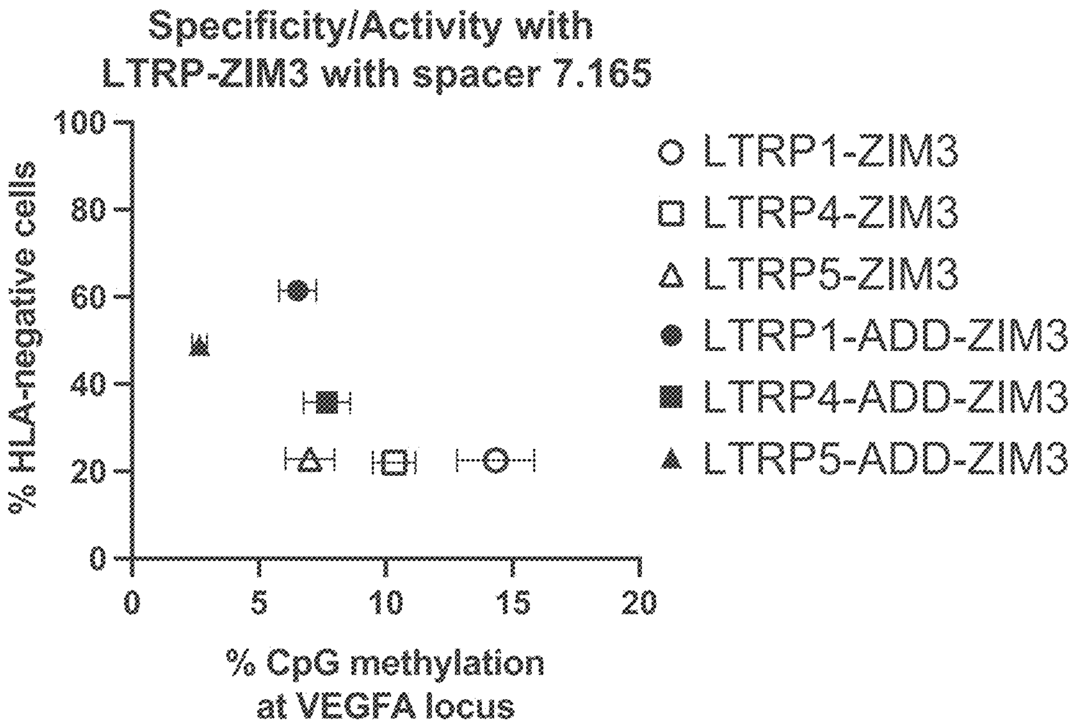

FIG. 52A is a dot plot showing the relative activity (average percentage of HLA-negative cells at day 27) versus specificity (percentage of off-target CpG methylation at the VEGFA locus quantified at day 5) for the LTRP molecules with the ZIM3-KRAB domain having configurations #1, #4, and #5, for B2M-targeting gRNA with spacer 7.165, as described in Example 15.

Figure 52B:
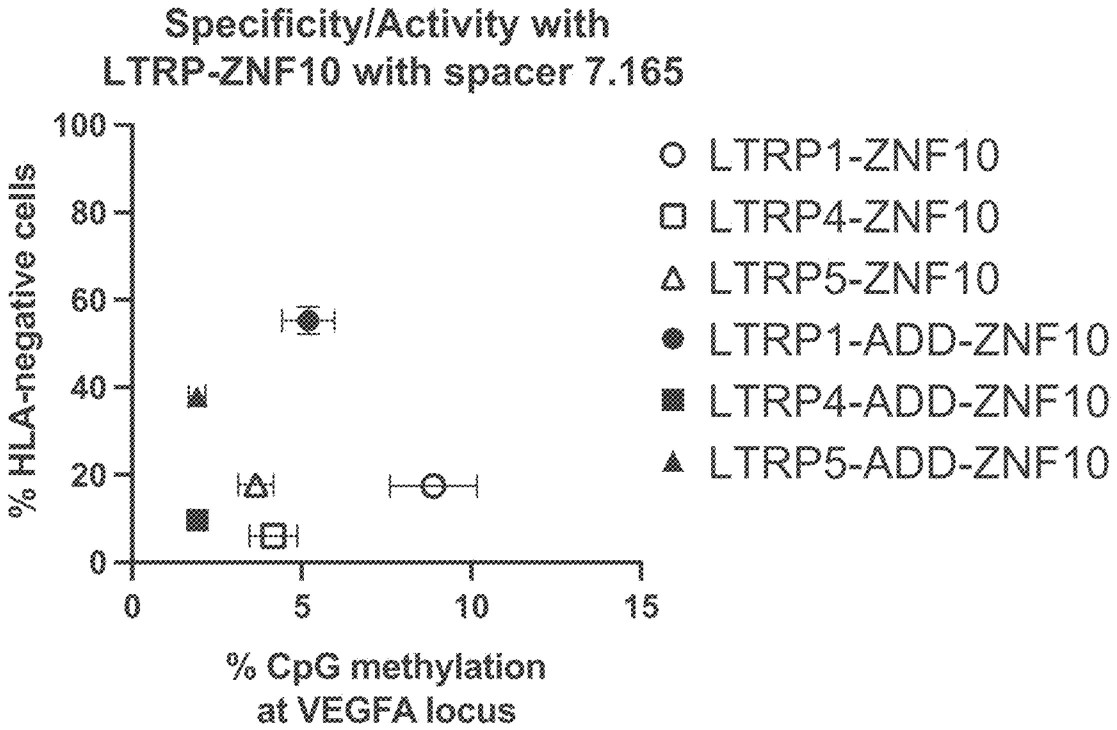

FIG. 52B is a dot plot showing the relative activity (average percentage of HLA-negative cells at day 27) versus specificity (percentage of off-target CpG methylation at the VEGFA locus quantified at day 5) for the LTRP molecules with the ZNF10-KRAB domain having configurations #1, #4, and #5, for B2M-targeting gRNA with spacer 7.165, as described in Example 15.

Figure 53:
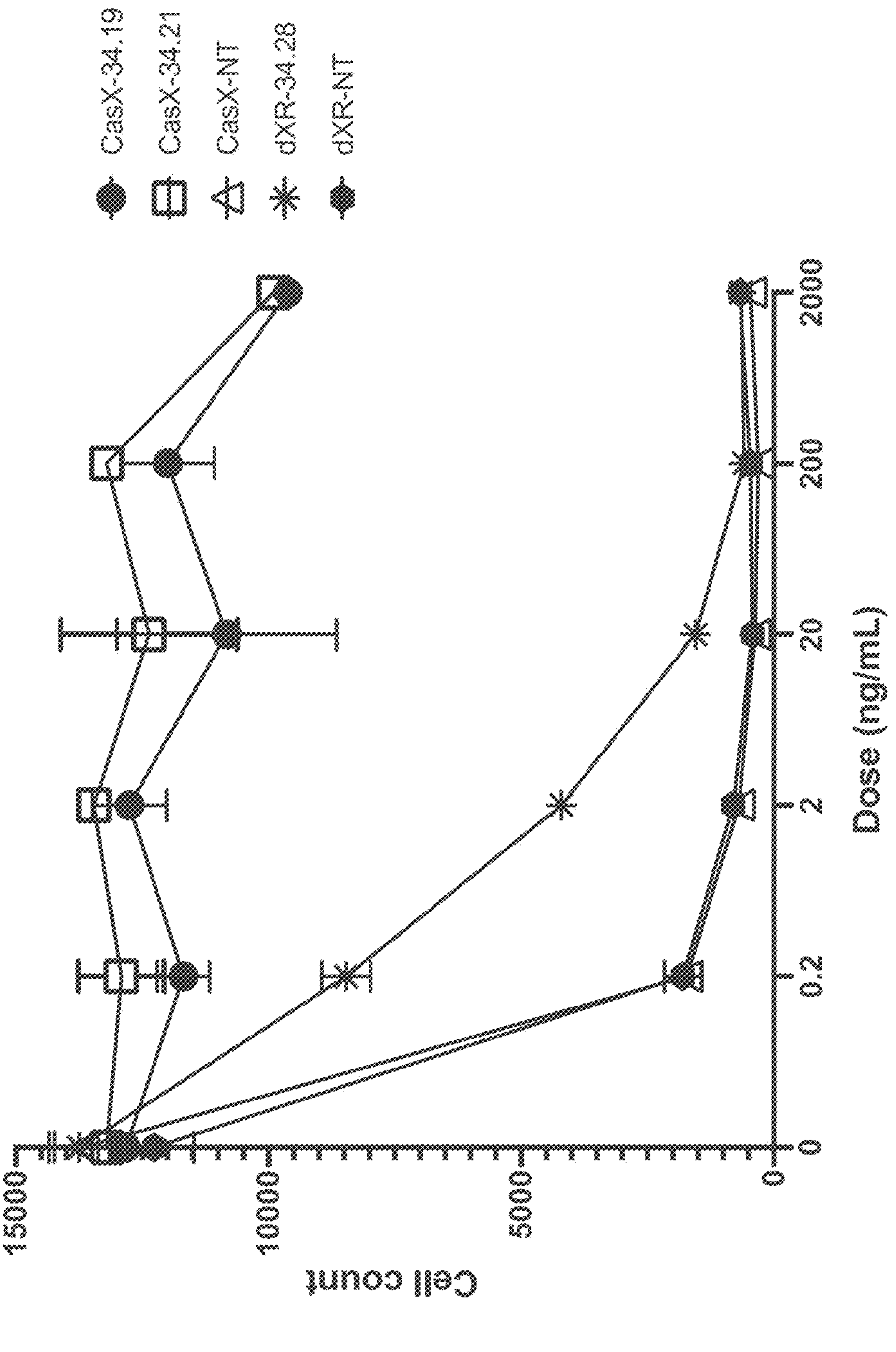

FIG. 53 shows the dose response results of the diphtheria toxin titration for cells transduced with either catalytically active CasX editors with gRNAs targeting the gene encoding the Heparin Binding EGF-like Growth Factor (HBEGF), i.e., CasX-34.19 and CasX-34.21; a catalytically-dead CasX (dCasX) protein linked to a repressor domain as a fusion protein targeted to HBEGF (dXR fusion proteins, i.e., dXR1-34.28); or a non-targeting dXR molecule (CasX-NT or dXR-NT), as described in Example 16. Data represent the mean and standard deviation of two biological replicates.

Figure 54:
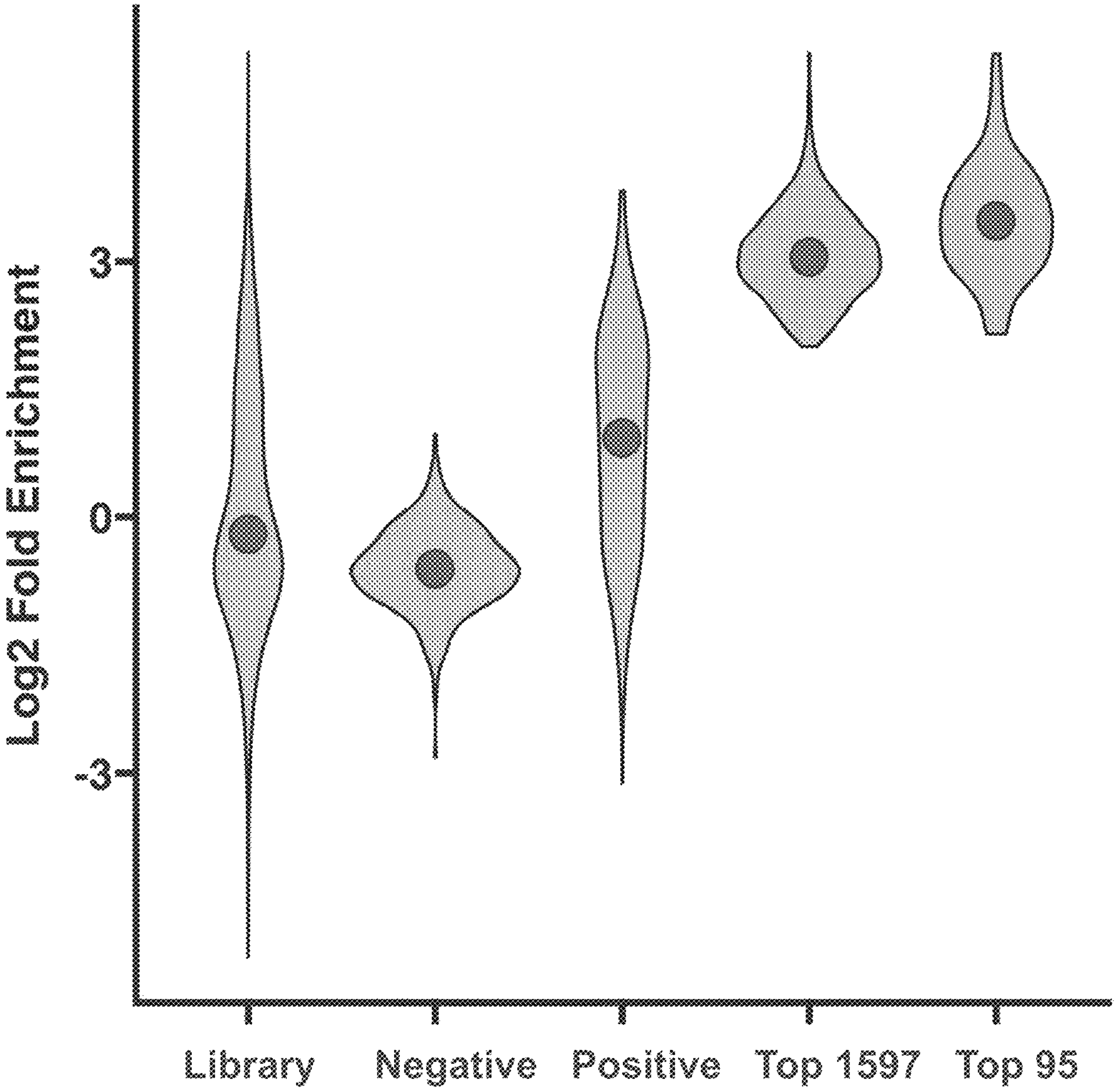

FIG. 54 provides violin plots showing the log 2 (fold change) of sequences before and after selection for their ability to support dXR repression of the HBEGF locus, as described in Example 17. The plots show the results for the entire library, a negative control set of sequences, a positive control set of known KRAB repressors, the top 1597 enhanced domains tested with log 2 (fold change)>2 and p-values<0.01, and the top 95 enhanced domains tested.

Figure 55:
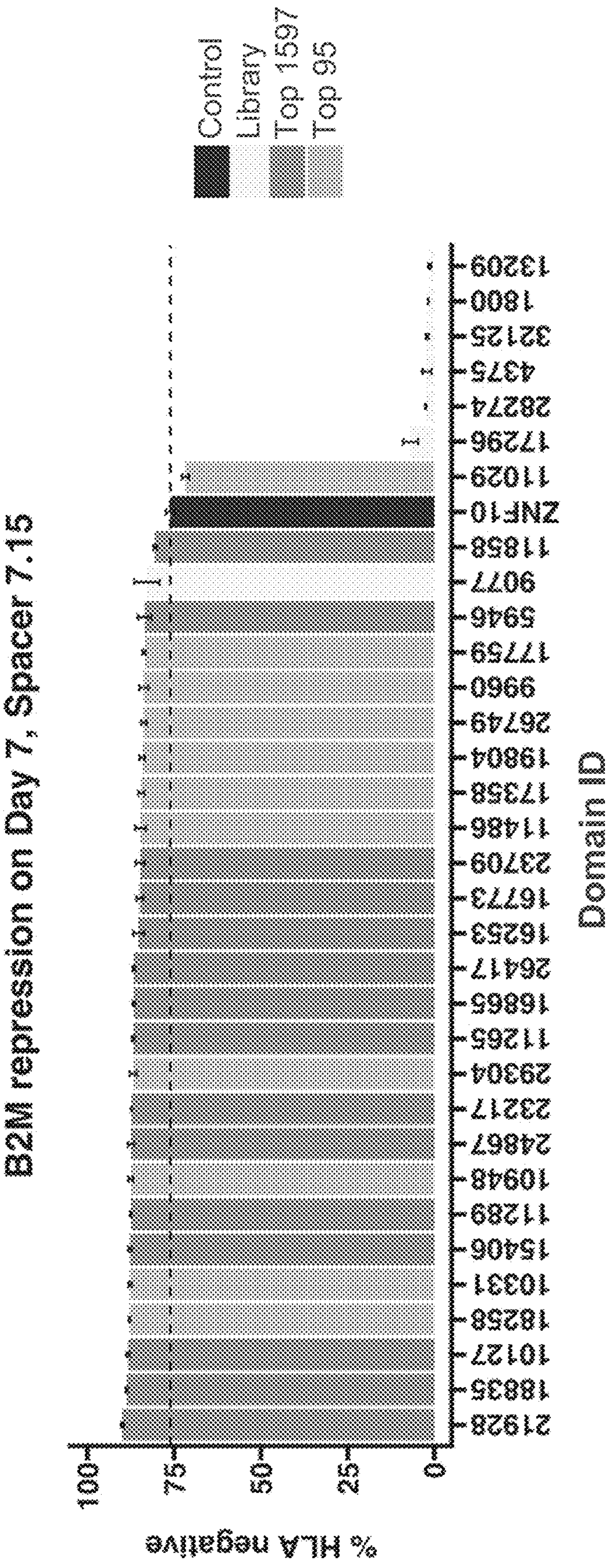

FIG. 55 shows B2M silencing activities (represented as percentage of HLA-negative cells) of dXR proteins with various repressor domains, as described in Example 17. Data are presented as mean with standard deviation, N=3.

Figure 56:
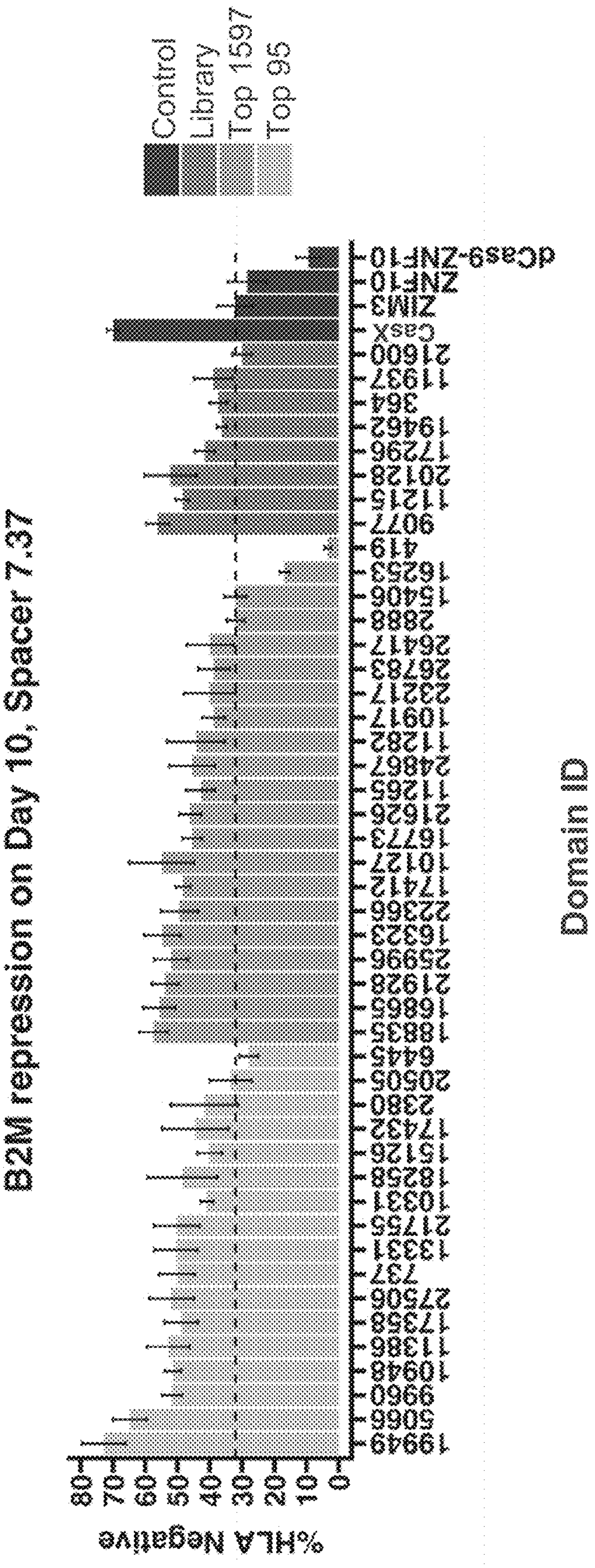

FIG. 56 shows B2M silencing activities (represented as percentage of HLA-negative cells) of dXR proteins with various repressor domains, as described in Example 17. Data are presented as mean with standard deviation, N=3.

Figure 57A:
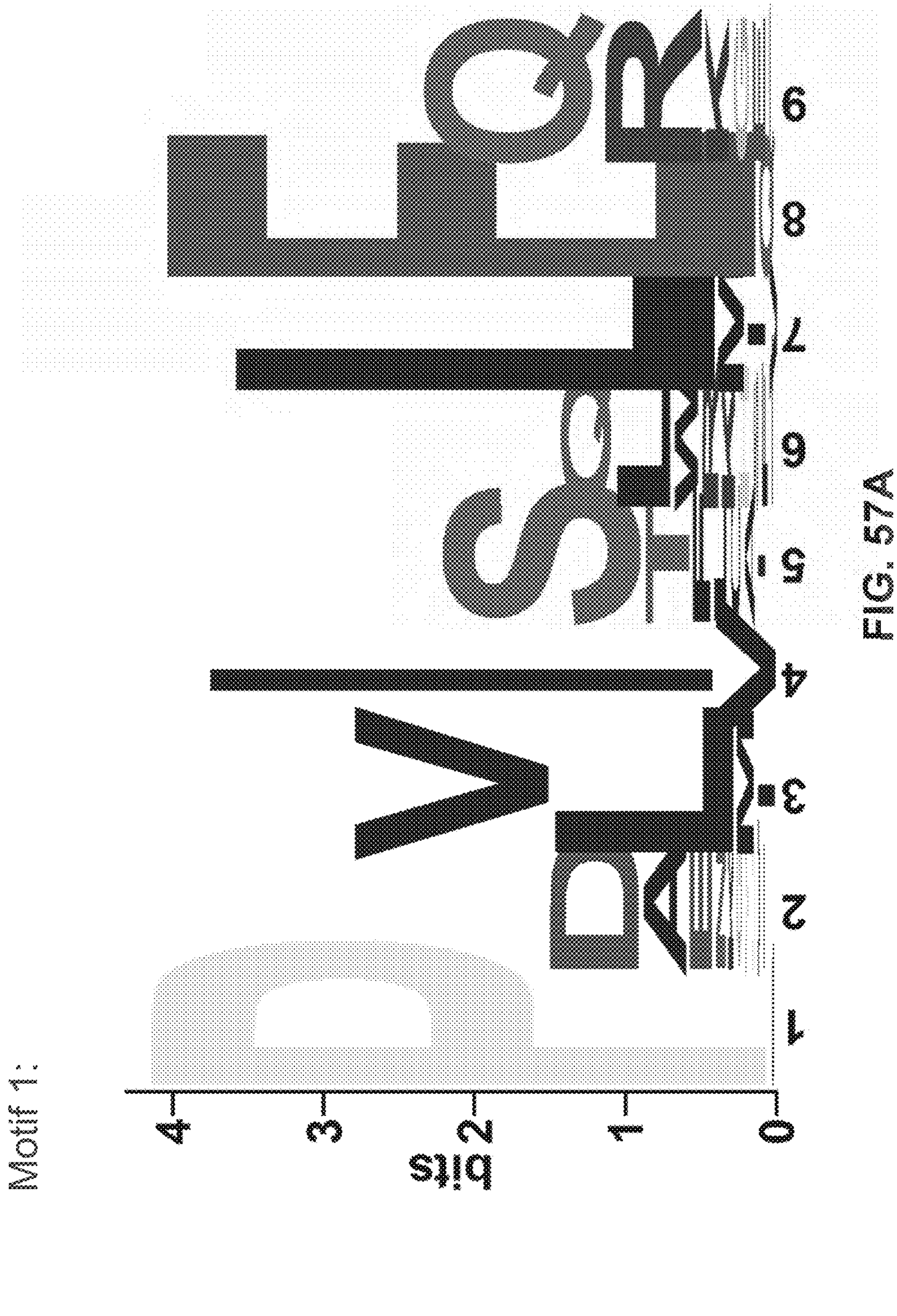

FIG. 57A provides the logo of repressor domain motif 1, as described in Example 17.

Figure 57B:
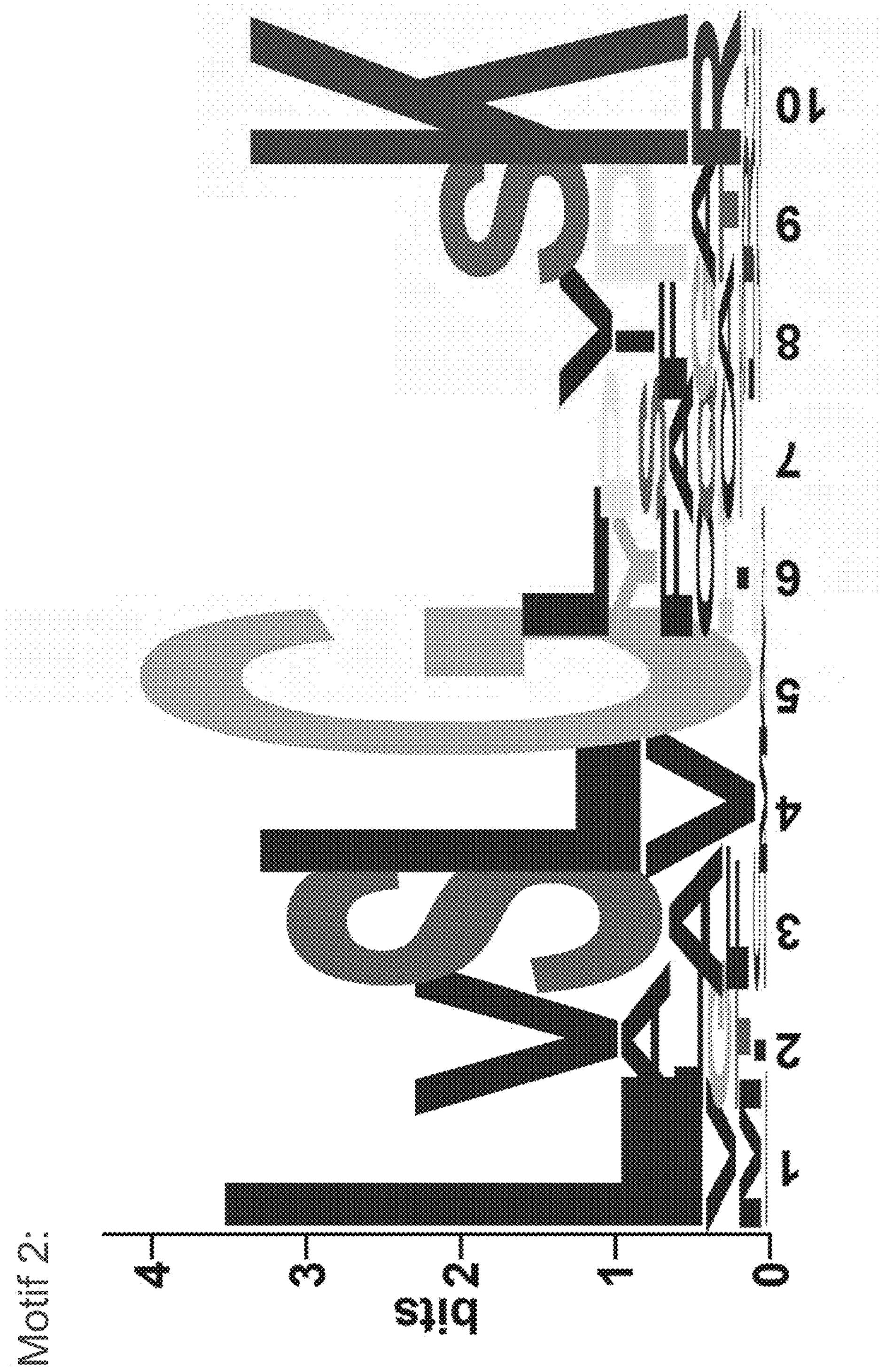

FIG. 57B provides the logo of repressor domain motif 2, as described in Example 17.

Figure 57C:
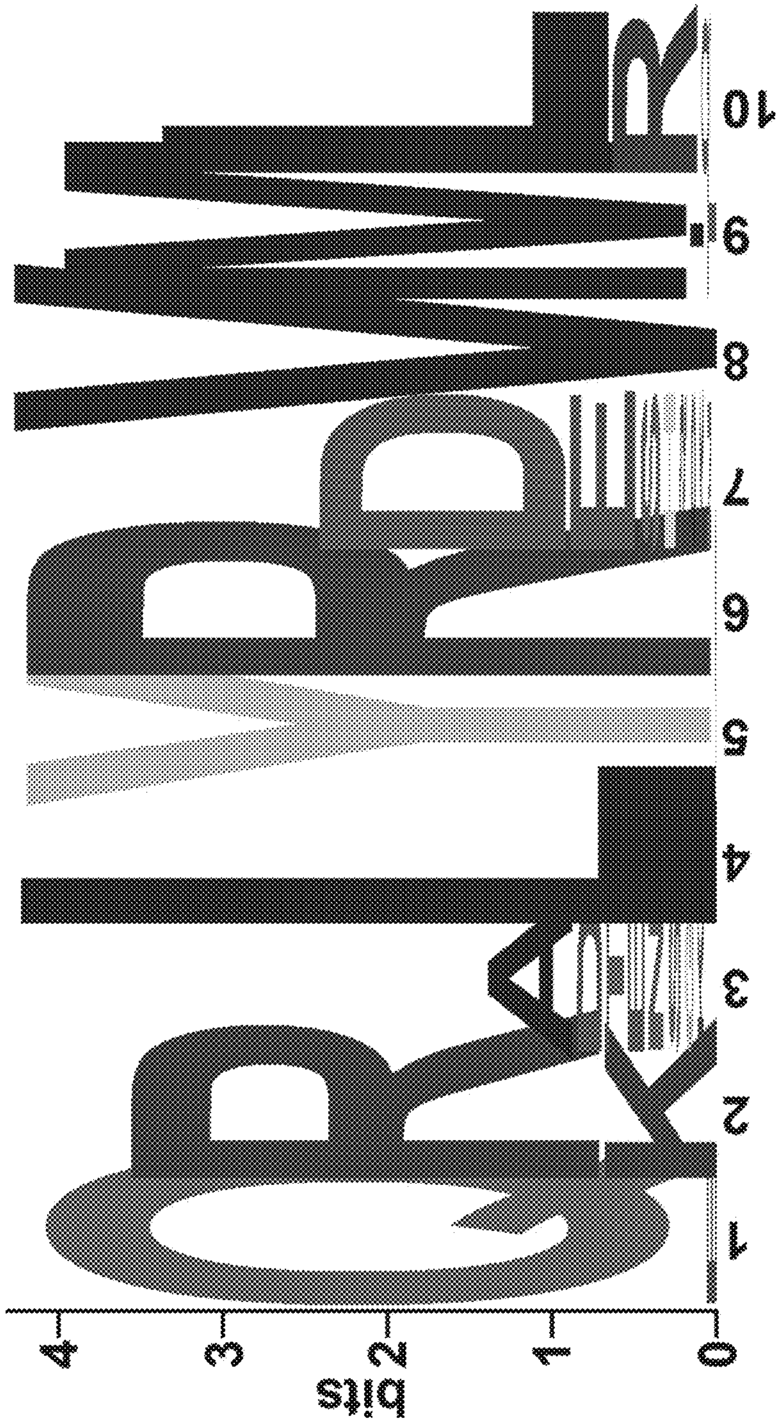

FIG. 57C provides the logo of repressor domain motif 3 (SEQ ID NO: 1727), as described in Example 17. The logo corresponds to SEQ ID NO: 1727.

Figure 57D:
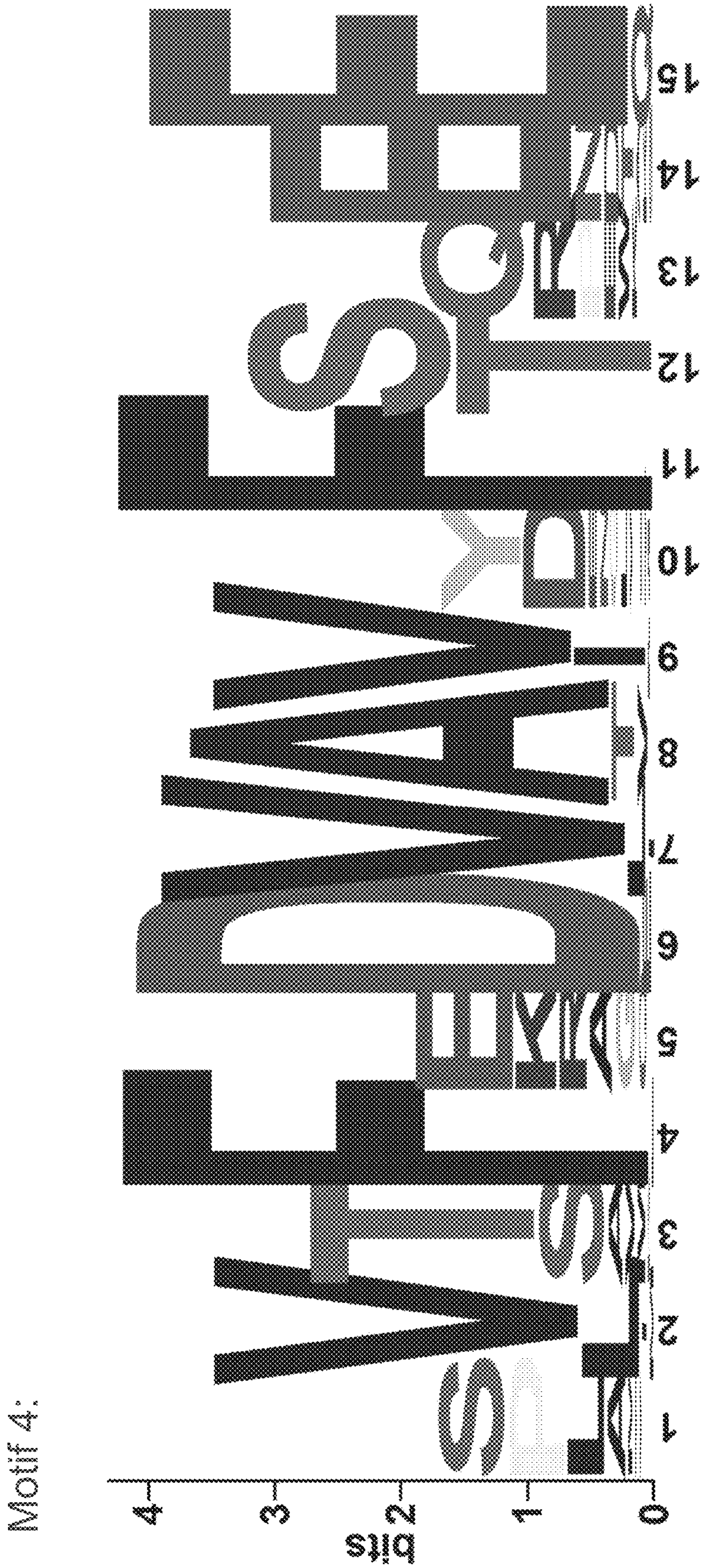

FIG. 57D provides the logo of repressor domain motif 4 (SEQ ID NO: 1728), as described in Example 17. The logo corresponds to SEQ ID NO: 1728.

Figure 57E:
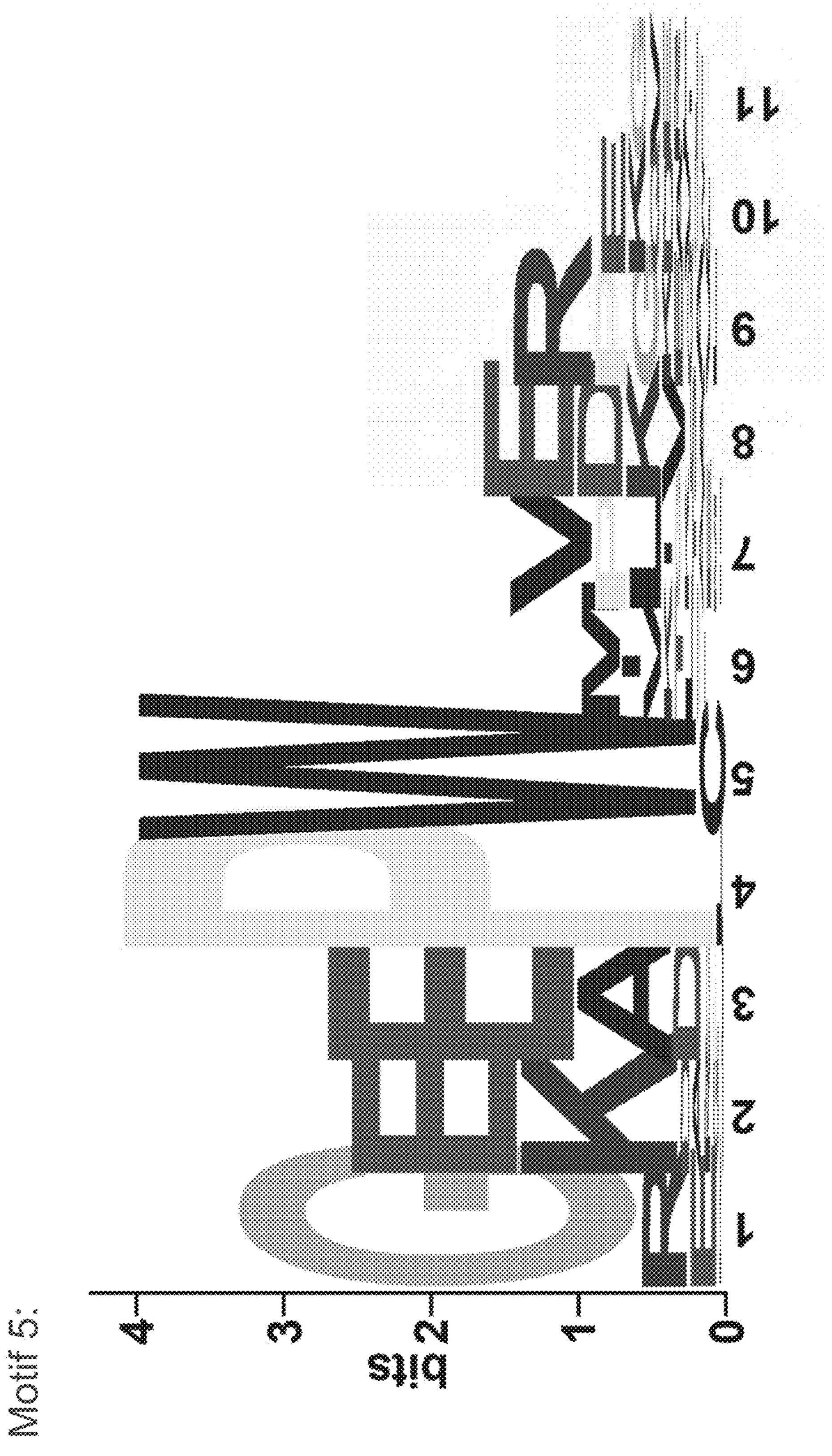

FIG. 57E provides the logo of repressor domain motif 5, as described in Example 17.

Figure 57F:
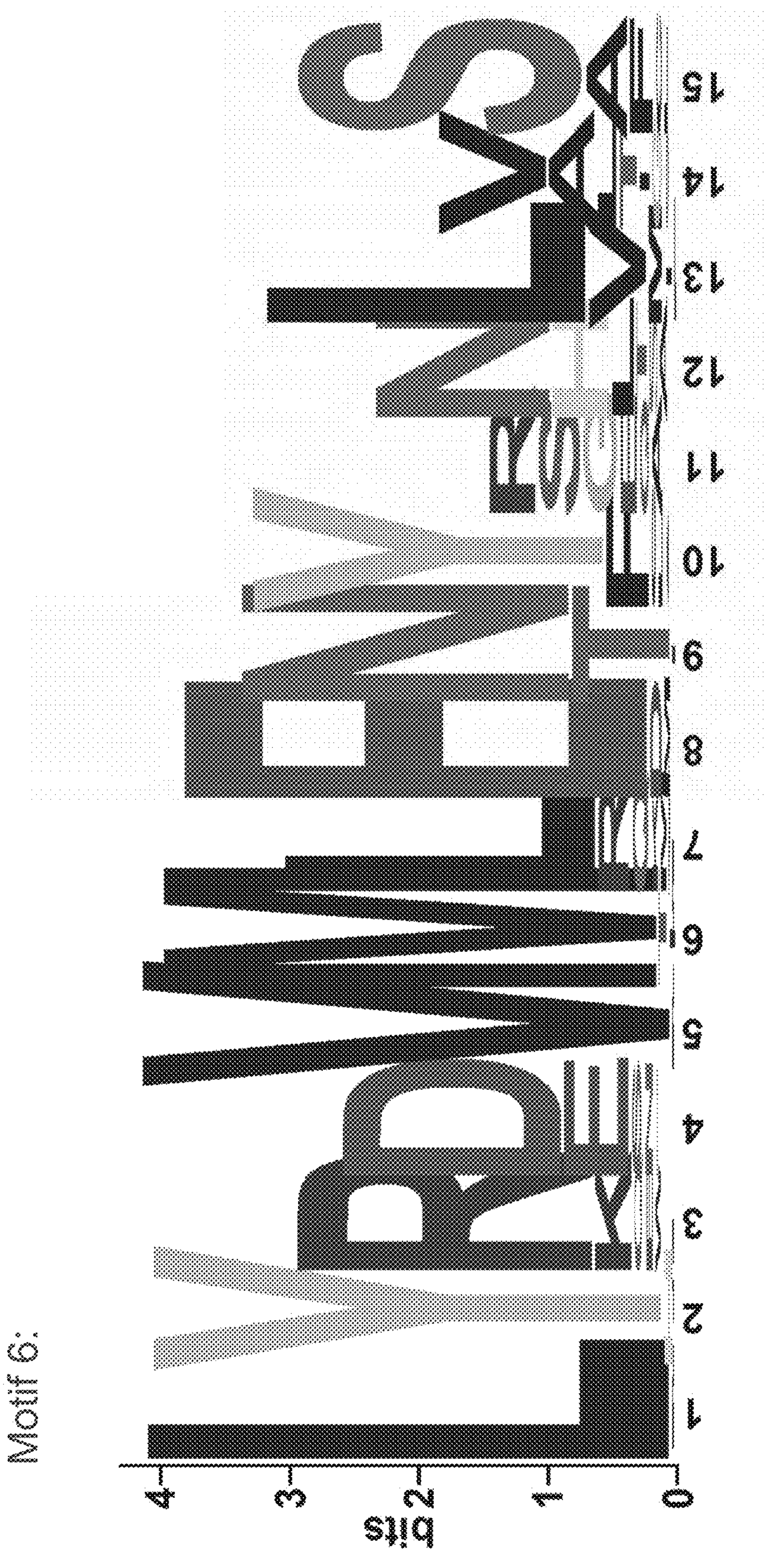

FIG. 57F provides the logo of repressor domain motif 6 (SEQ ID NO: 1729), as described in Example 17. The logo corresponds to SEQ ID NO: 1729.

Figure 57G:
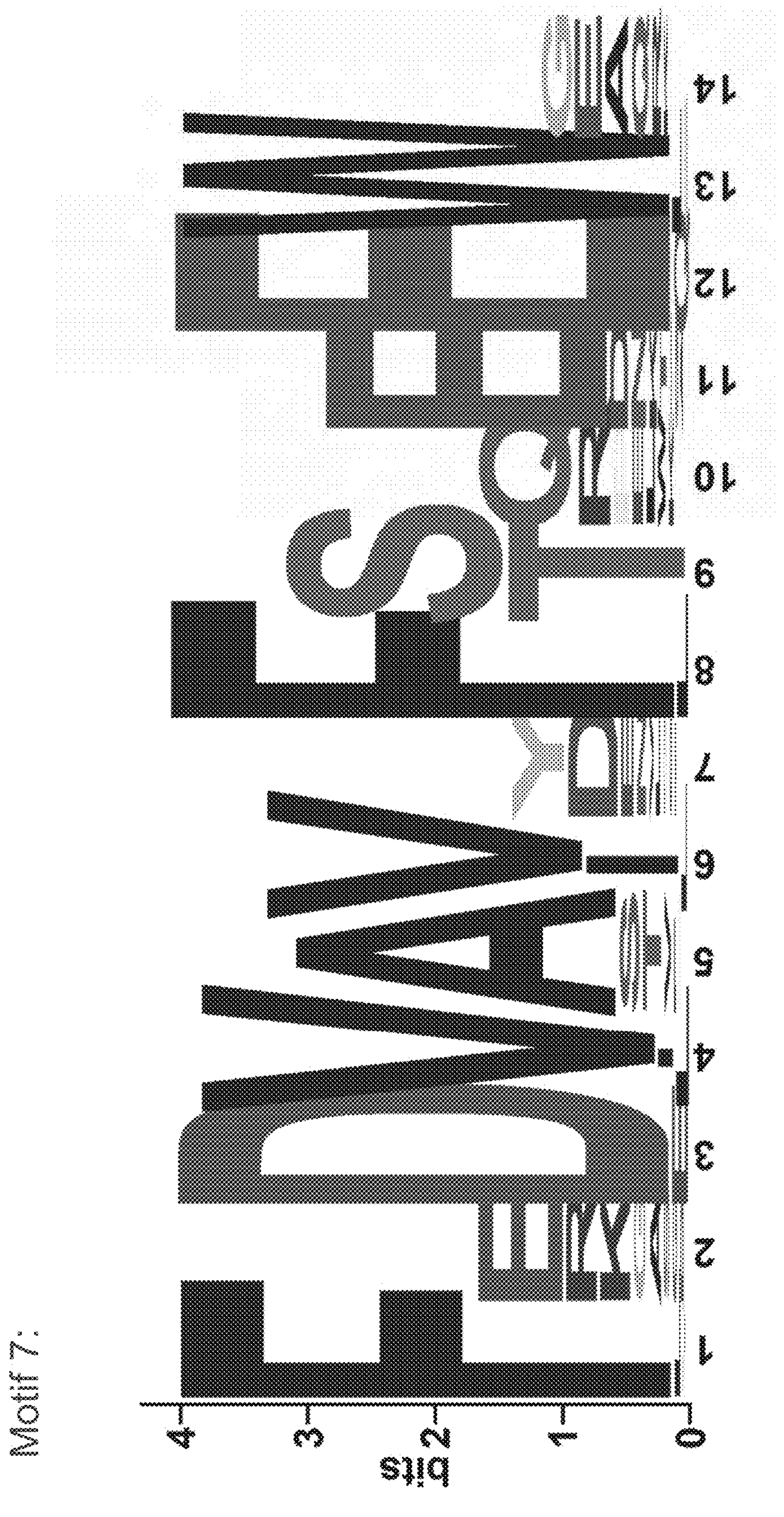

FIG. 57G provides the logo of repressor domain motif 7 (SEQ ID NO: 1730), as described in Example 17.

Figure 57H:
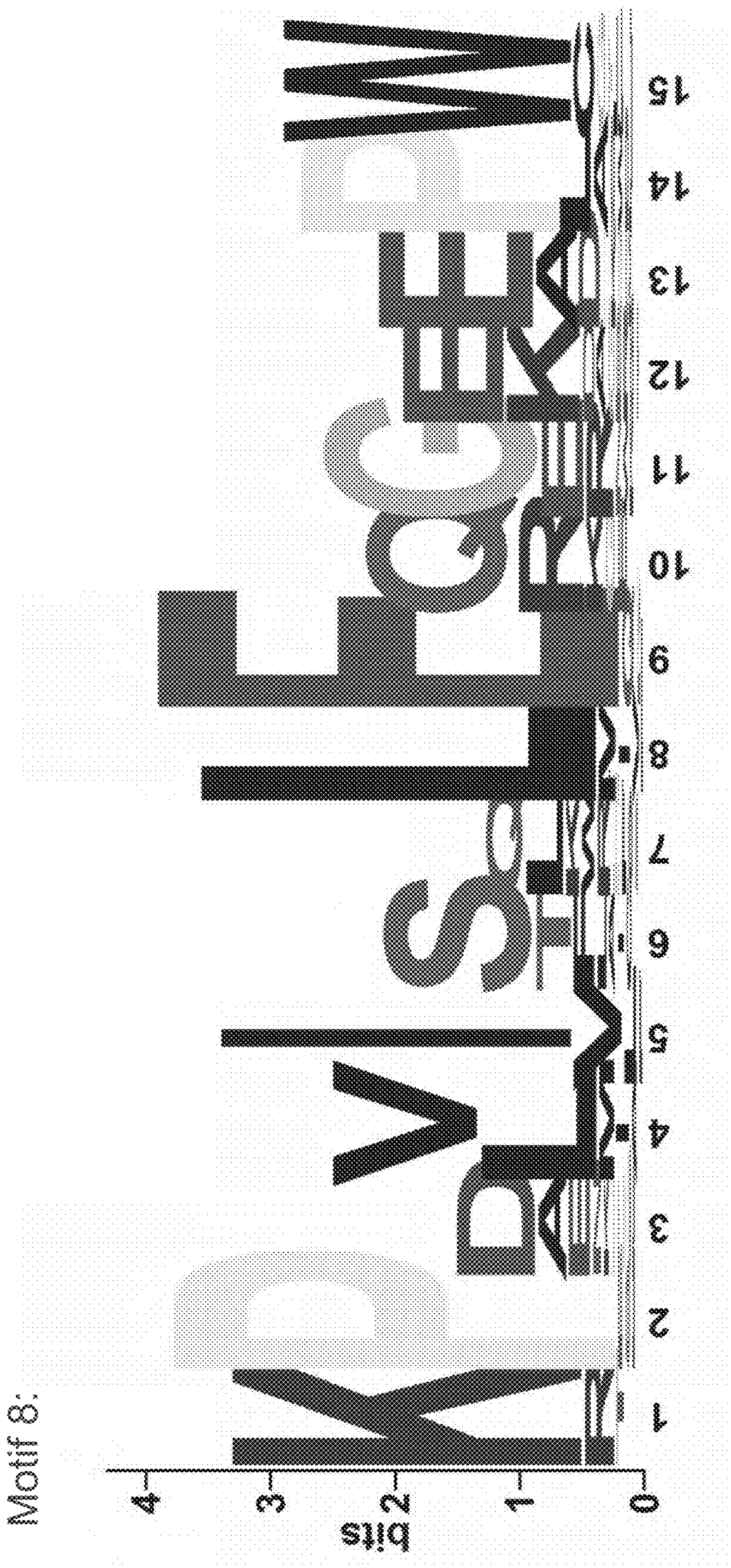

FIG. 57H provides the logo of repressor domain motif 8, as described in Example 17.

Figure 57I:
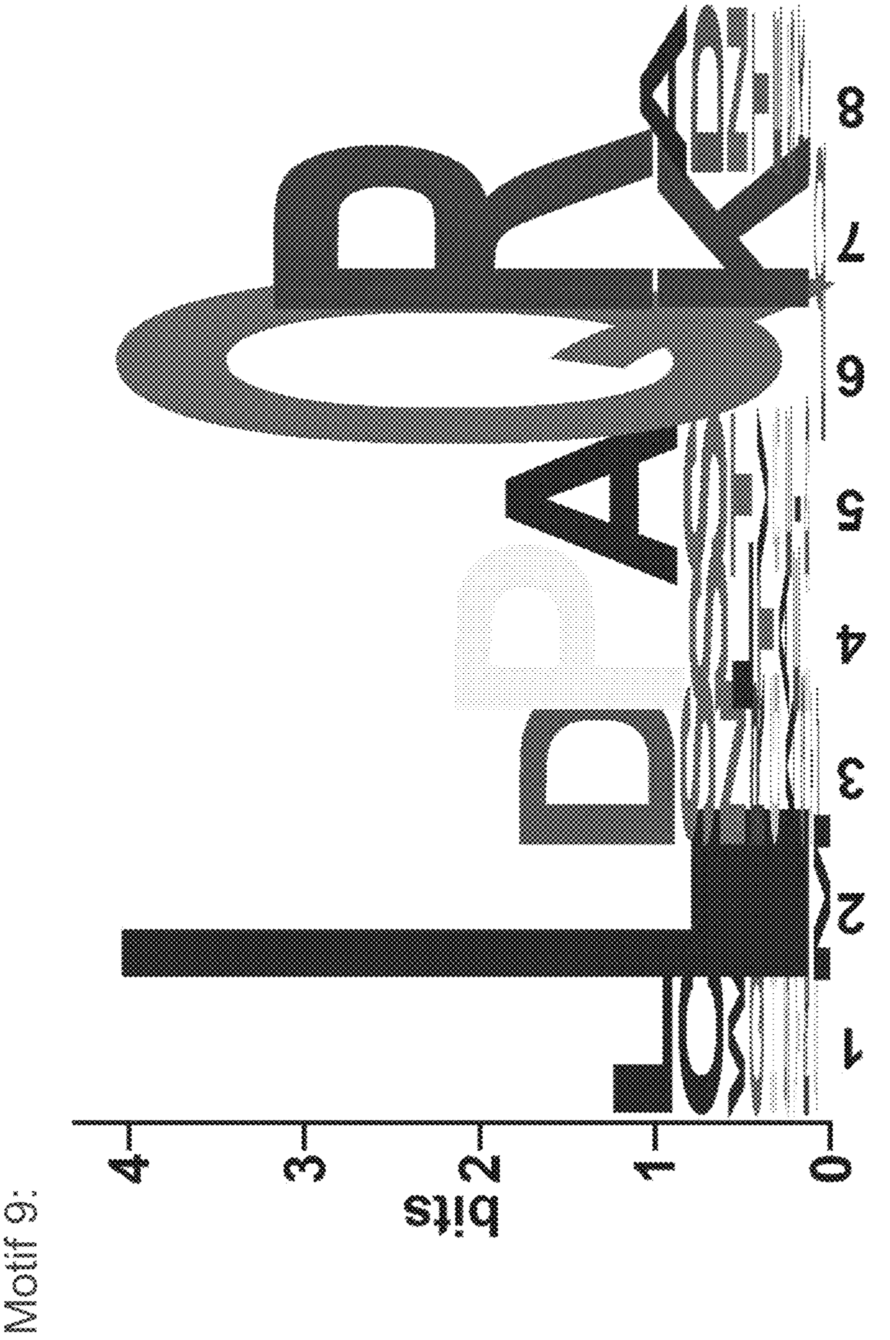

FIG. 57I provides the logo of repressor domain motif 9, as described in Example 17.

Figure 58A:
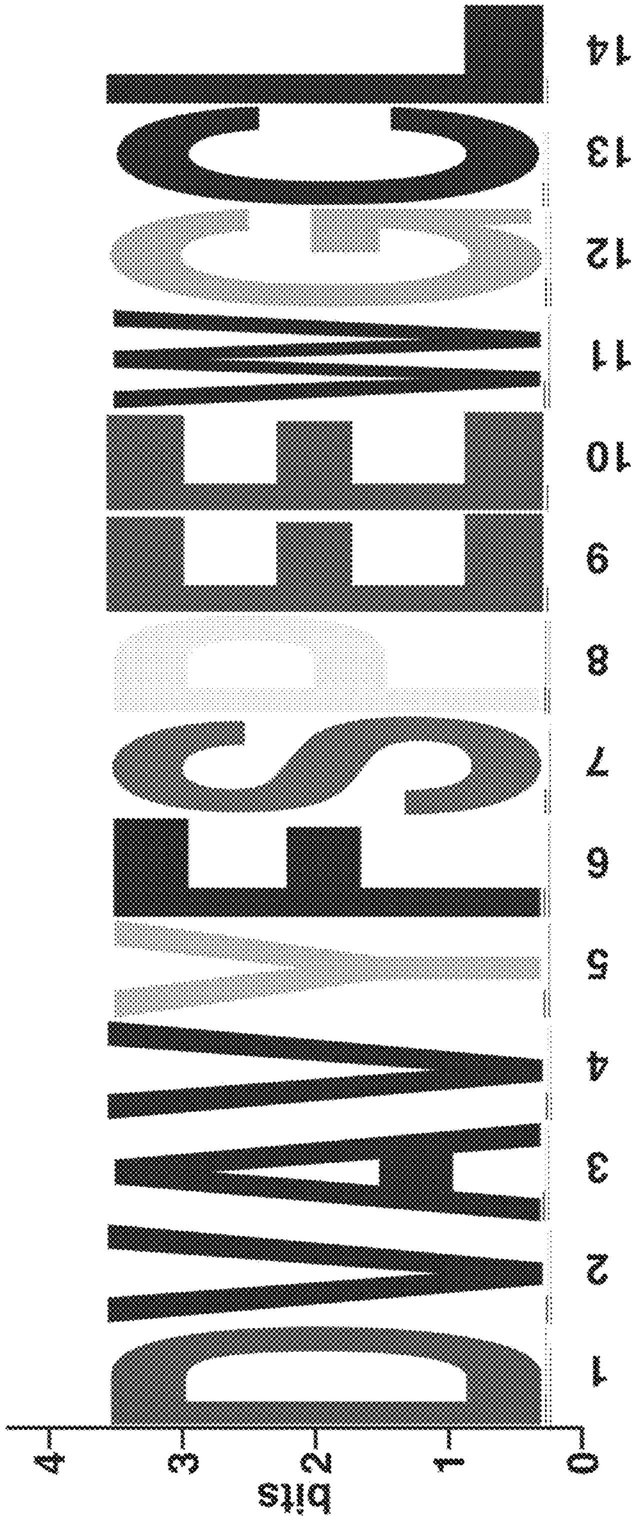

FIG. 58A provides the logo of alternative repressor domain motif 1 (SEQ ID NO: 2945), as described in Example 19. The logo corresponds to SEQ ID NO: 2945.

Figure 58B:
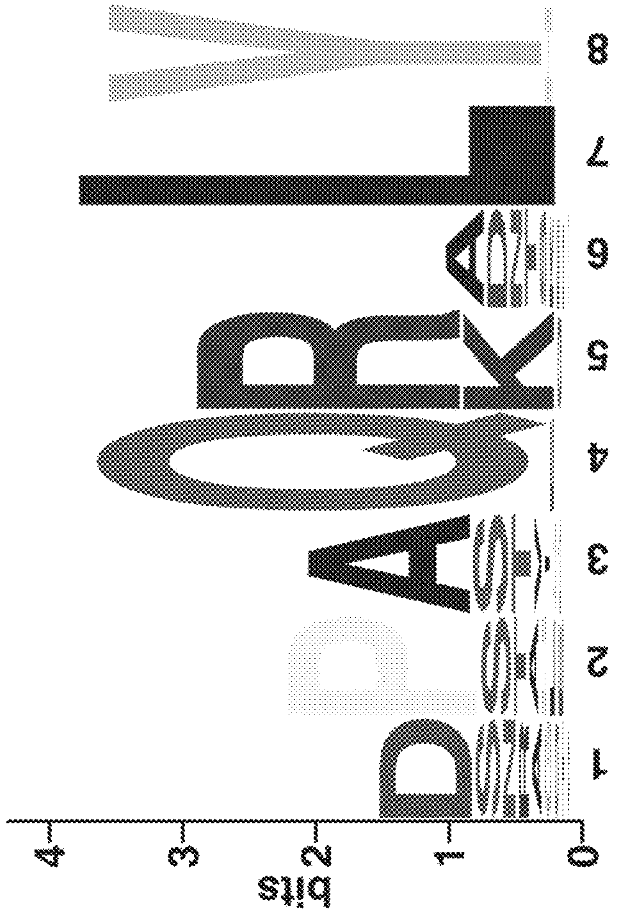

FIG. 58B provides the logo of alternative repressor domain motif 2, as described in Example 19.

Figure 58C:
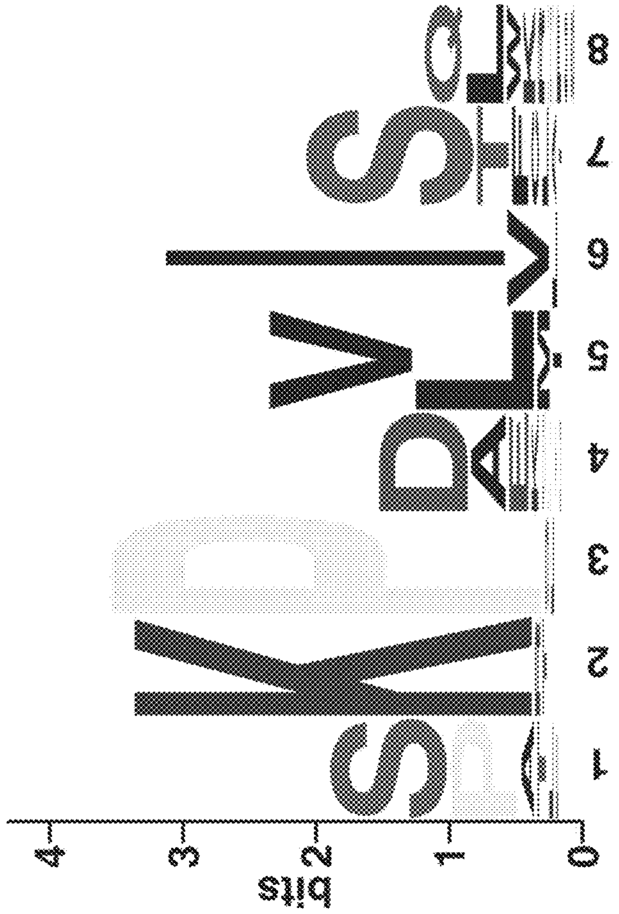

FIG. 58C provides the logo of alternative repressor domain motif 3, as described in Example 19.

Figure 58D:
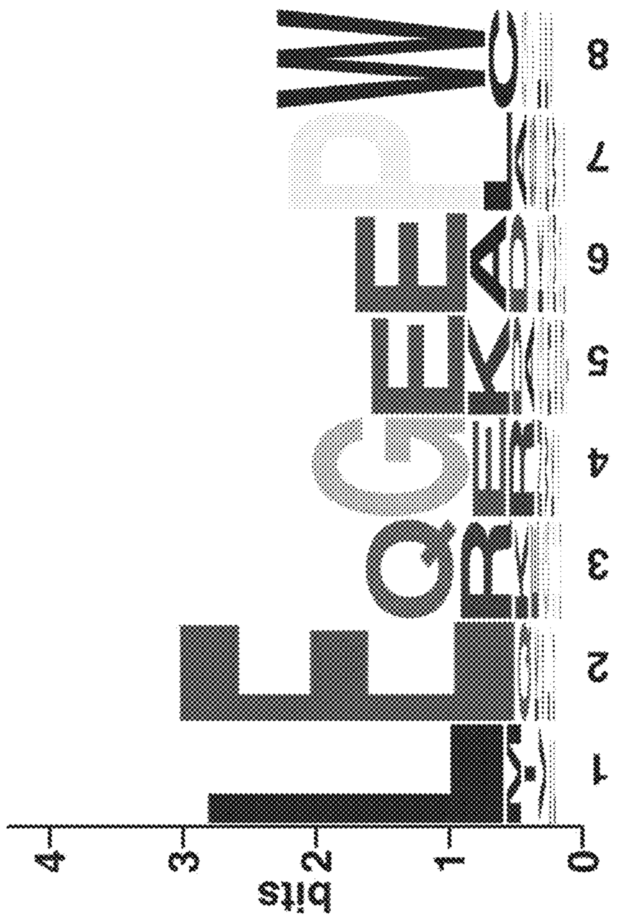

FIG. 58D provides the logo of alternative repressor domain motif 4, as described in Example 19.

Figure 58E:
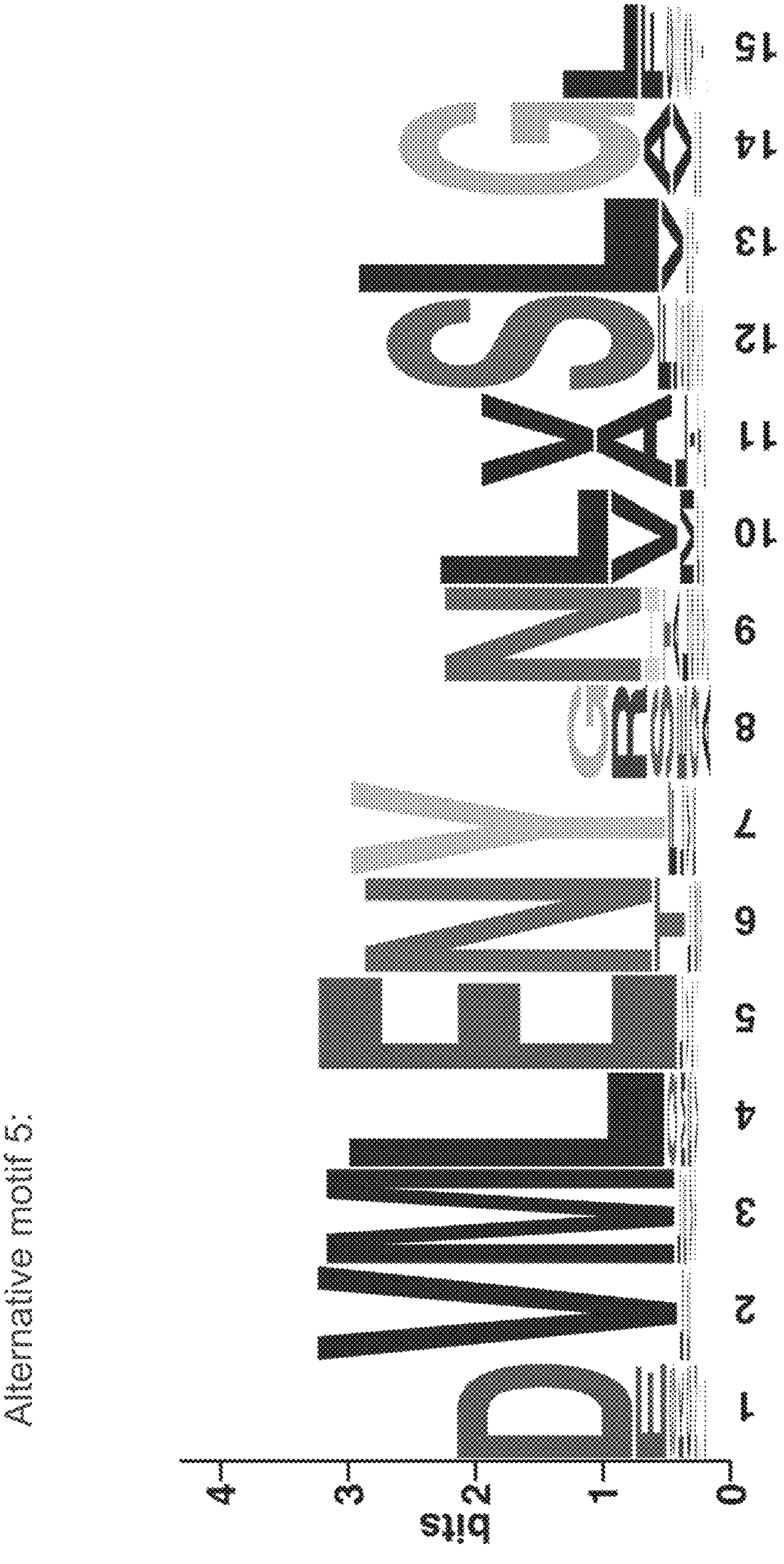

FIG. 58E provides the logo of alternative repressor domain motif 5 (SEQ ID NO: 2946), as described in Example 19. The logo corresponds to SEQ ID NO: 2946.

Figure 59:
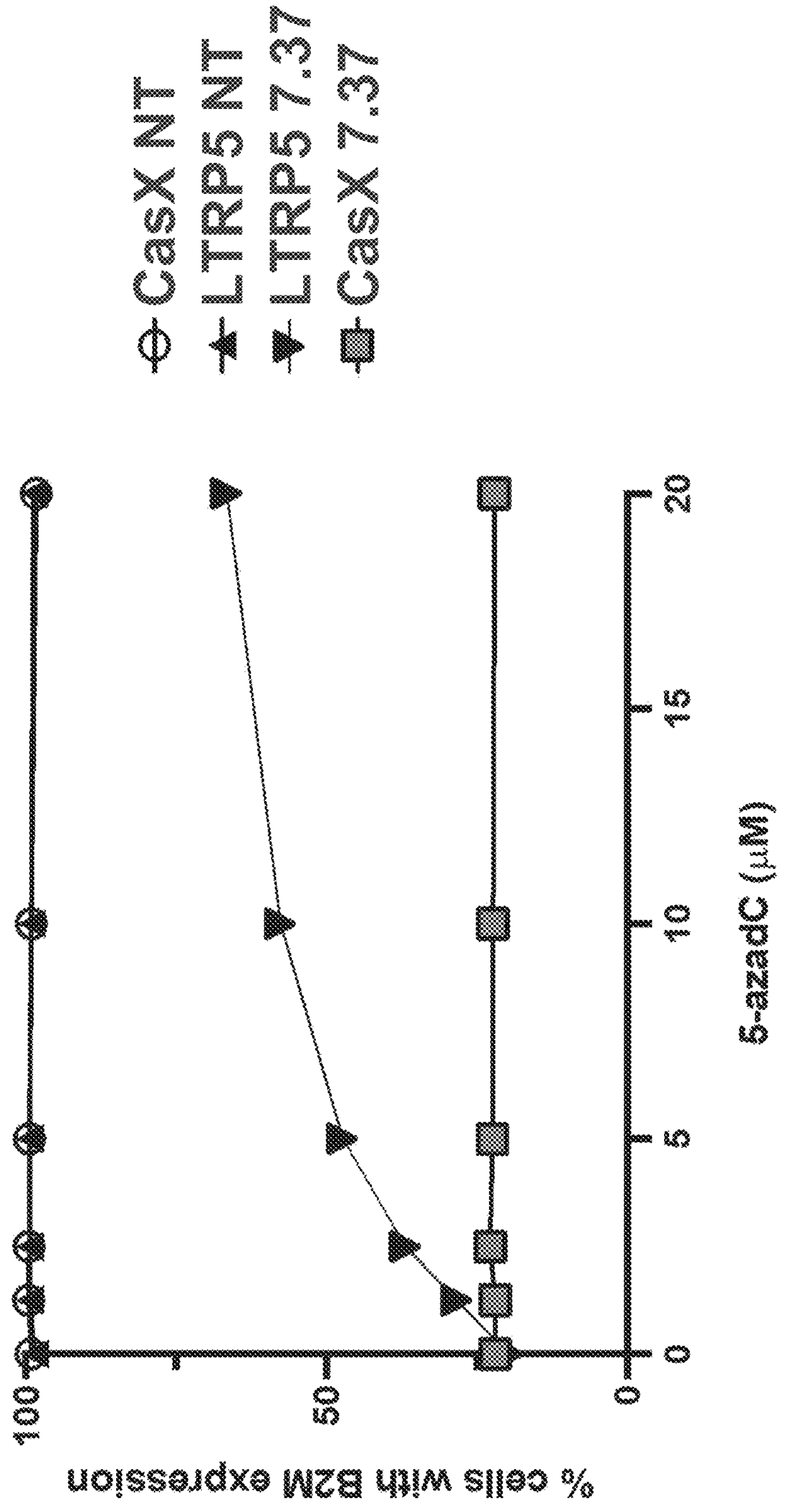

FIG. 59 is a plot illustrating percentage of HEK293T cells, transfected with a plasmid encoding the indicated CasX or LTRP:gRNA construct, that expressed B2M six days post-treatment with the DNMT1 inhibitor 5-azadC at varying concentrations, as described in Example 20.

Figure 60:
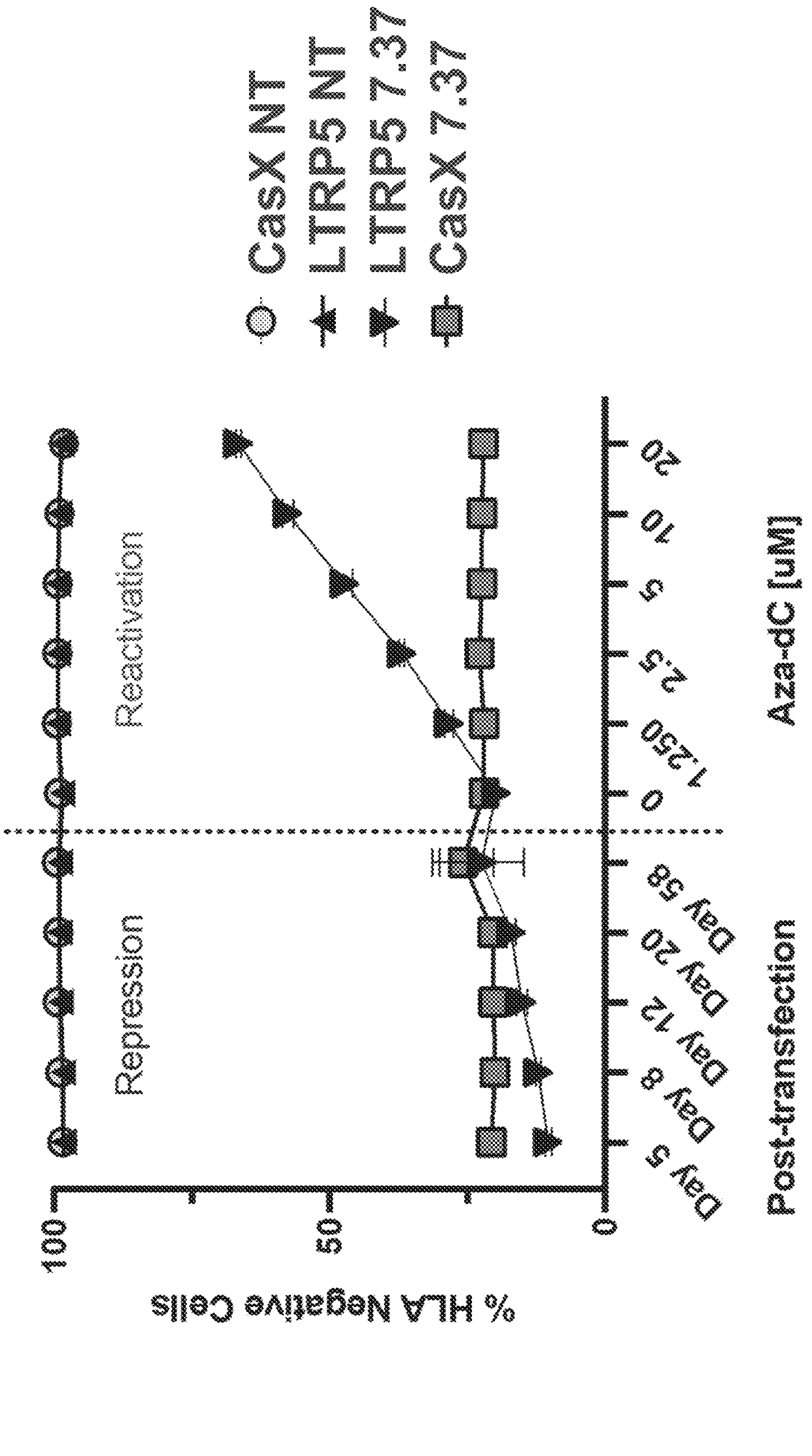

FIG. 60 is a plot that juxtaposes the quantification of B2M repression in HEK293T cells transfected with a plasmid encoding the indicated CasX or LTRP:gRNA construct and cultured for 58 days, with the quantification of B2M reactivation upon treatment of transfected cells with 5-azadC, as described in Example 20.

Figure 61:
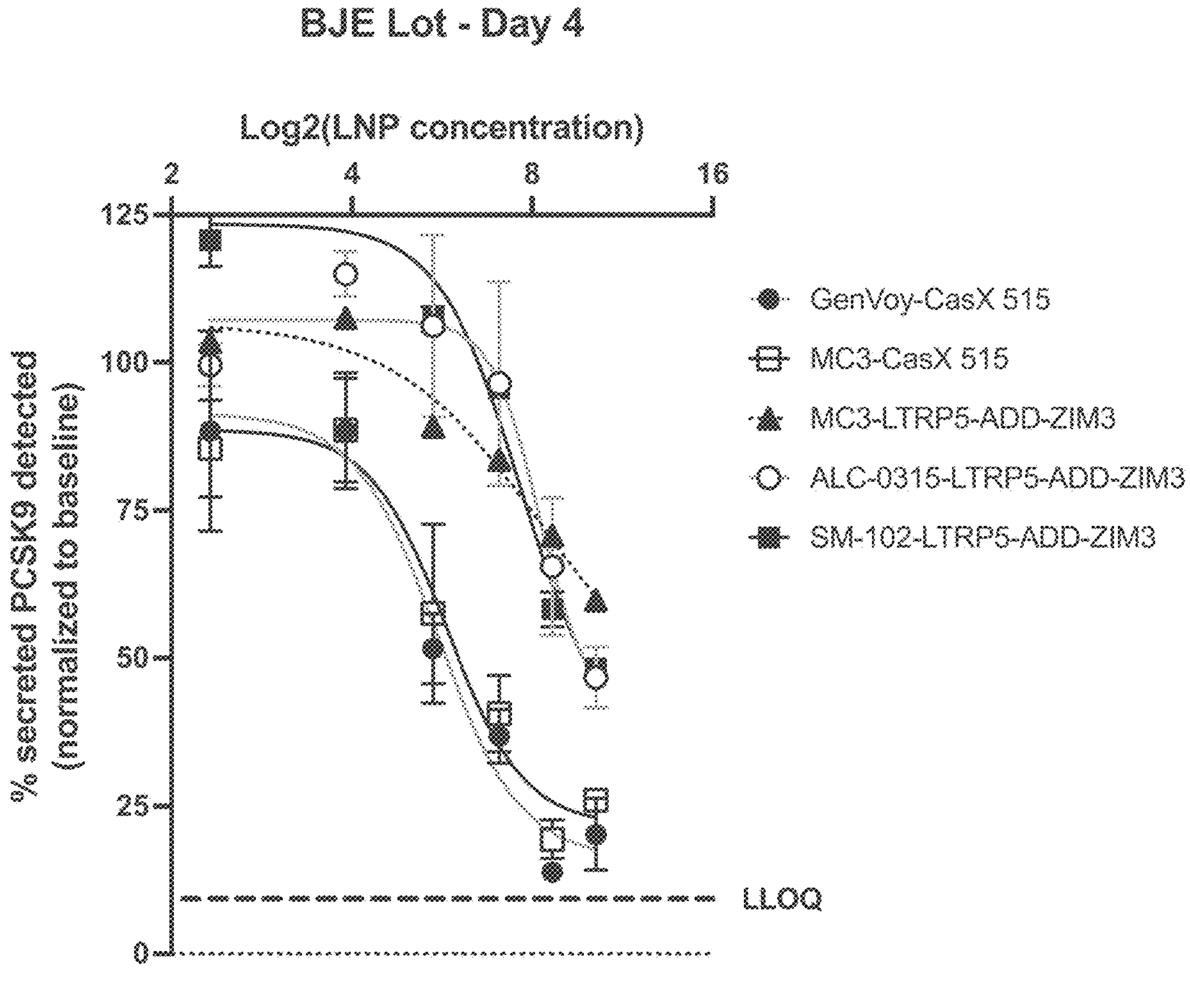

FIG. 61 is a plot illustrating the percent of secreted PCSK9, normalized to baseline PCSK9 secretion levels, at 4 days post-treatment, for primary cynomolgus macaque (CM) hepatocytes from the BJE lot. CM hepatocytes were treated with the indicated doses of LNPs formulated with CasX 515 or LTRP5-ADD-ZIM3 mRNA and a PCSK9-targeting gRNA with spacer 6.1, as described in Example 10. The dashed line represents the lower limit of quantitation (LLOQ).

Figure 62:
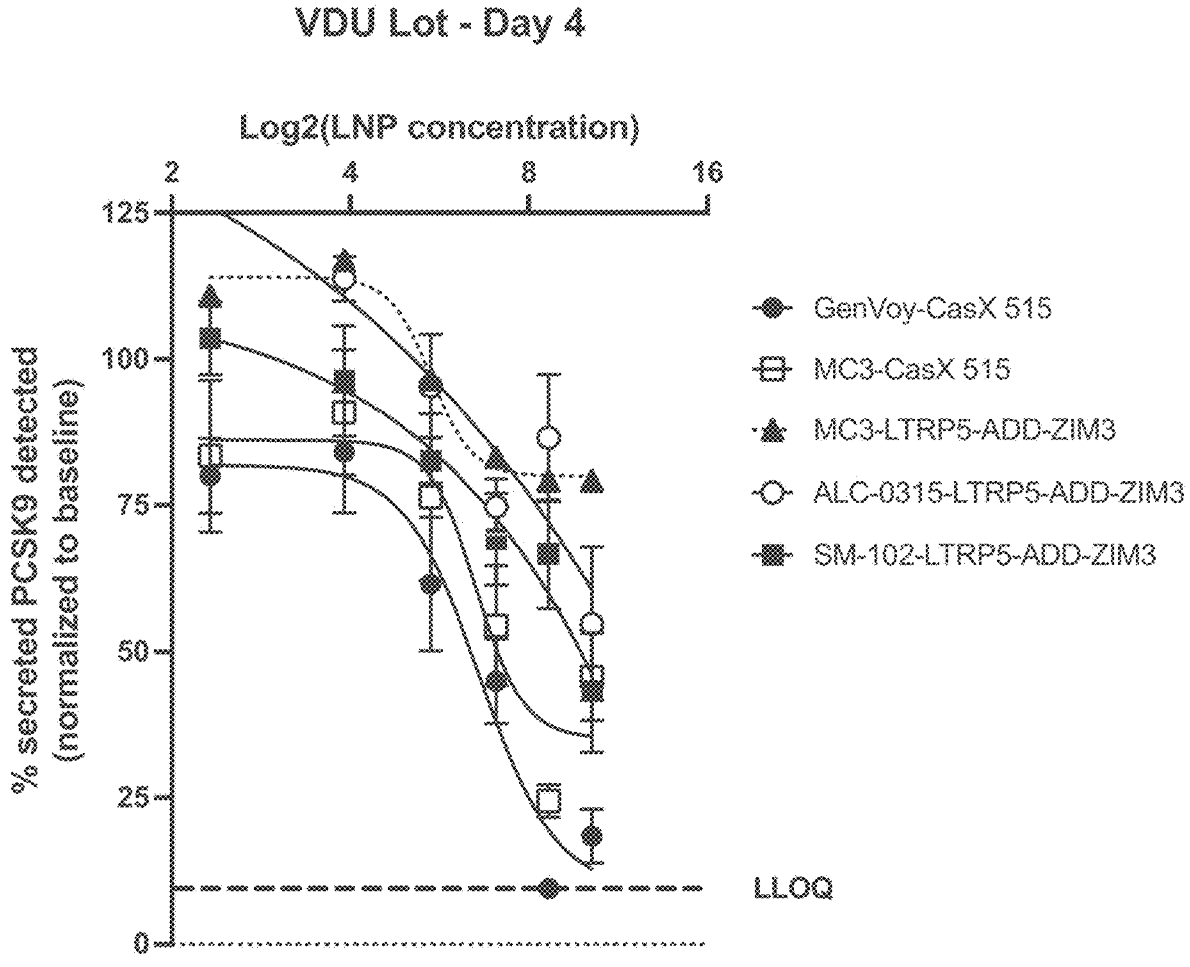

FIG. 62 is a plot illustrating the percent of secreted PCSK9, normalized to baseline PCSK9 secretion levels, at 4 days post-treatment, for primary CM hepatocytes from the VDU lot. CM hepatocytes were treated with the indicated doses of LNPs formulated with CasX 515 or LTRP5-ADD-ZIM3 mRNA and a PCSK9-targeting gRNA with spacer 6.1, as described in Example 10. The dashed line represents the lower limit of quantitation (LLOQ).

Figure 63:
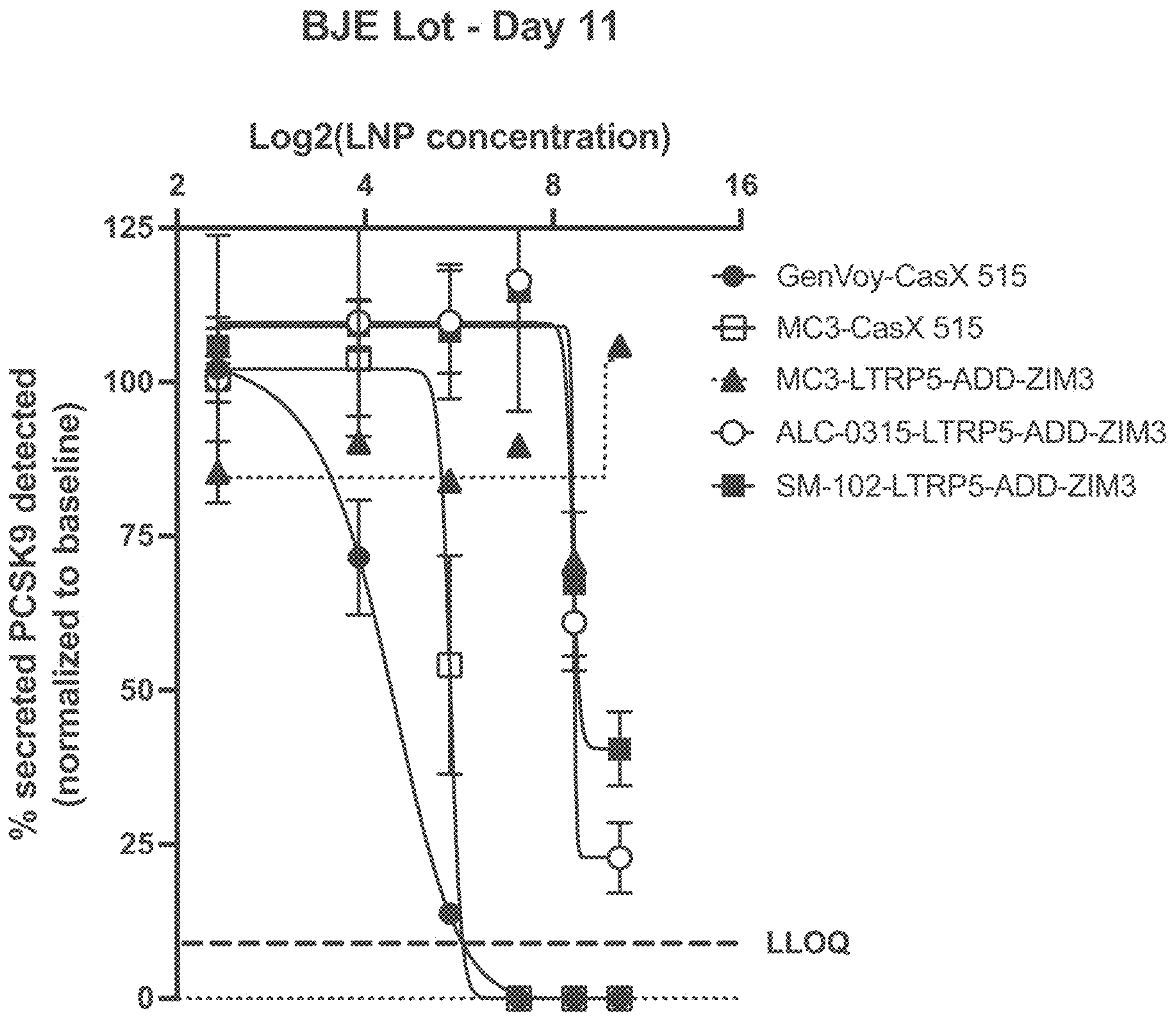

FIG. 63 is a plot illustrating the percent of secreted PCSK9, normalized to baseline PCSK9 secretion levels, at 11 days post-treatment, for primary CM hepatocytes from the BJE lot. CM hepatocytes were treated with the indicated doses of LNPs formulated with CasX 515 or LTRP5-ADD-ZIM3 mRNA and a PCSK9-targeting gRNA with spacer 6.1, as described in Example 10. The dashed line represents the lower limit of quantitation (LLOQ).

Figure 64:
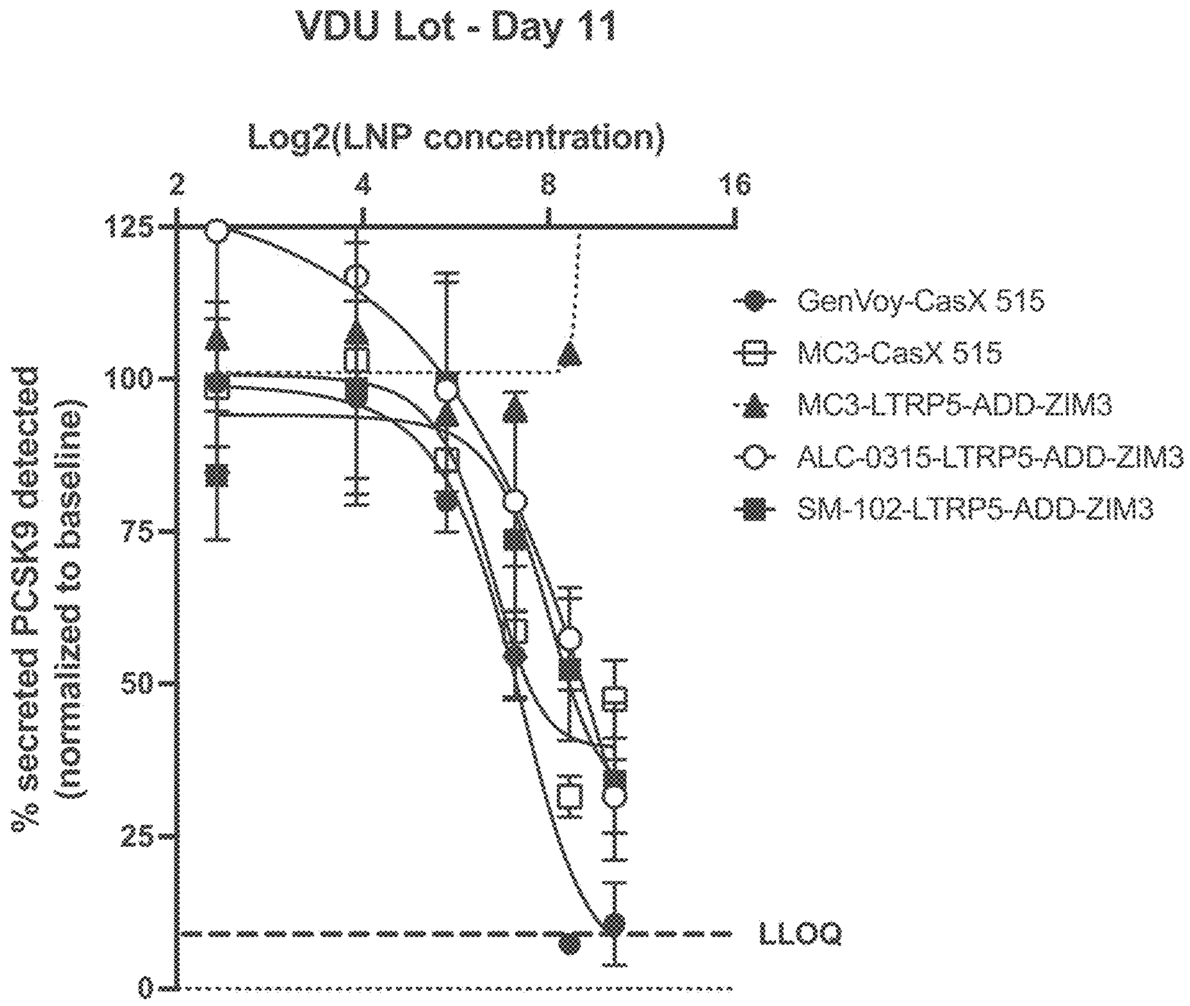

FIG. 64 is a plot illustrating the percent of secreted PCSK9, normalized to baseline PCSK9 secretion levels, at 11 days post-treatment, for primary CM hepatocytes from the VDU lot. CM hepatocytes treated with the indicated doses of LNPs formulated with CasX 515 or LTRP5-ADD-ZIM3 mRNA and a PCSK9-targeting gRNA with spacer 6.1, as described in Example 10. The dashed line represents the lower limit of quantitation (LLOQ).

Figure 65B:
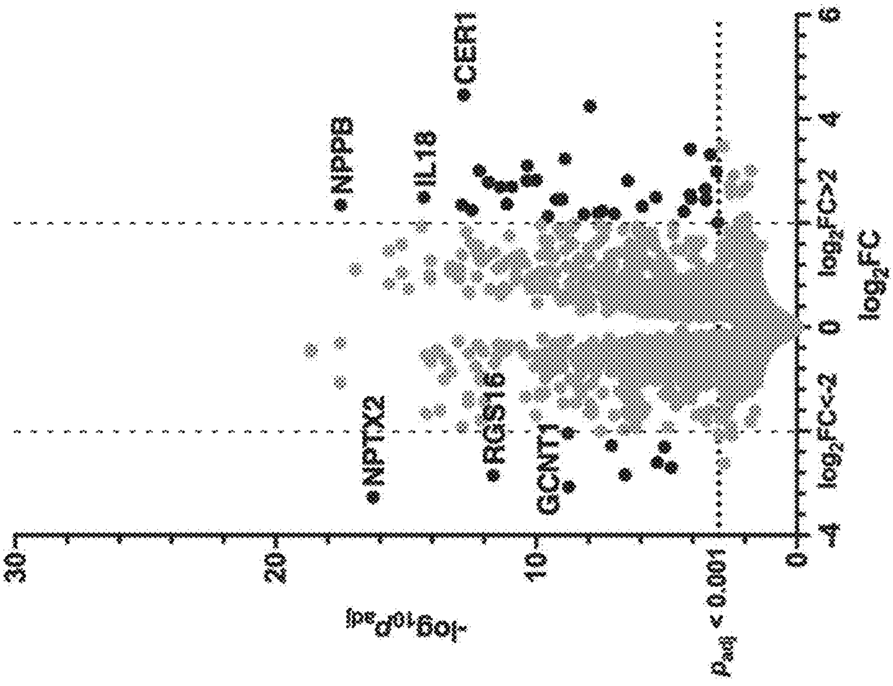
Figure 65A:
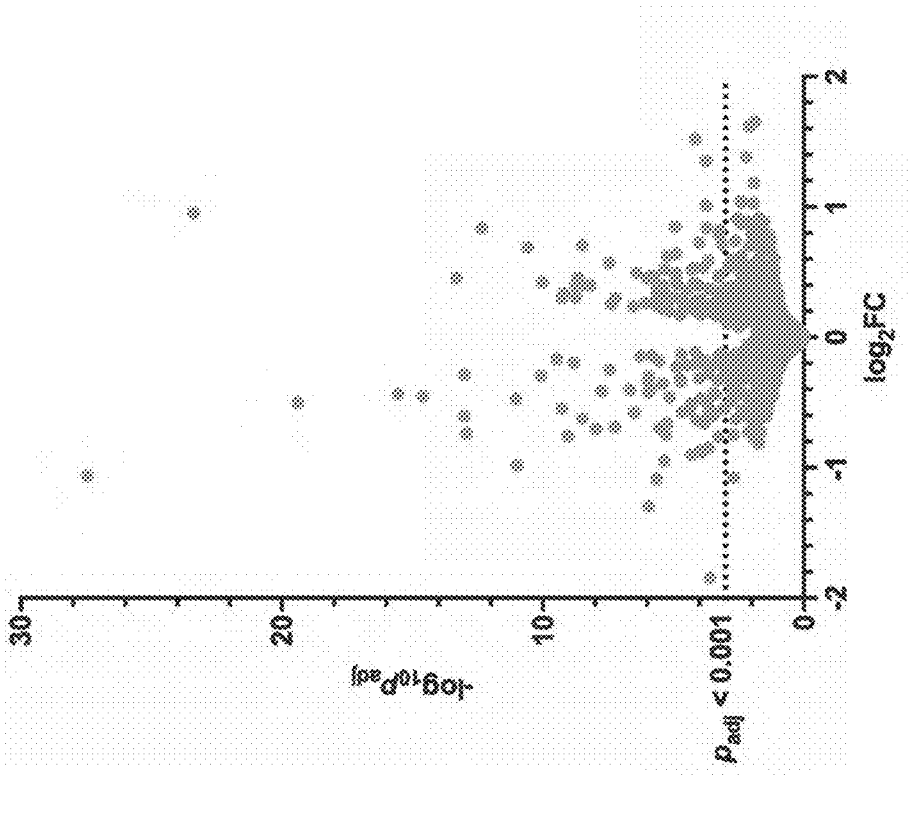

FIG. 65A is a volcano plot showing the differential gene expression analysis (log 2 fold changes (log 2FC) of read counts) comparing LTRP5-ADD-ZIM3 paired with a non-targeting (NT) spacer with the untreated, naïve control at 6 days post-transfection. The horizontal dotted line shows the adjusted p<0.001.

FIG. 65B is a volcano plot showing the differential gene expression analysis (log 2FC of read counts) comparing LTRP5-ADD-ZIM3 paired with a non-targeting (NT) spacer with the untreated, naïve control at 26 days post-transfection. The horizontal dotted line shows the adjusted p<0.001, and the vertical lines show the |log 2FC|>2 threshold. Black dots are the identified differentially regulated off-target genes after applying the two significance thresholds.

Figure 66B:
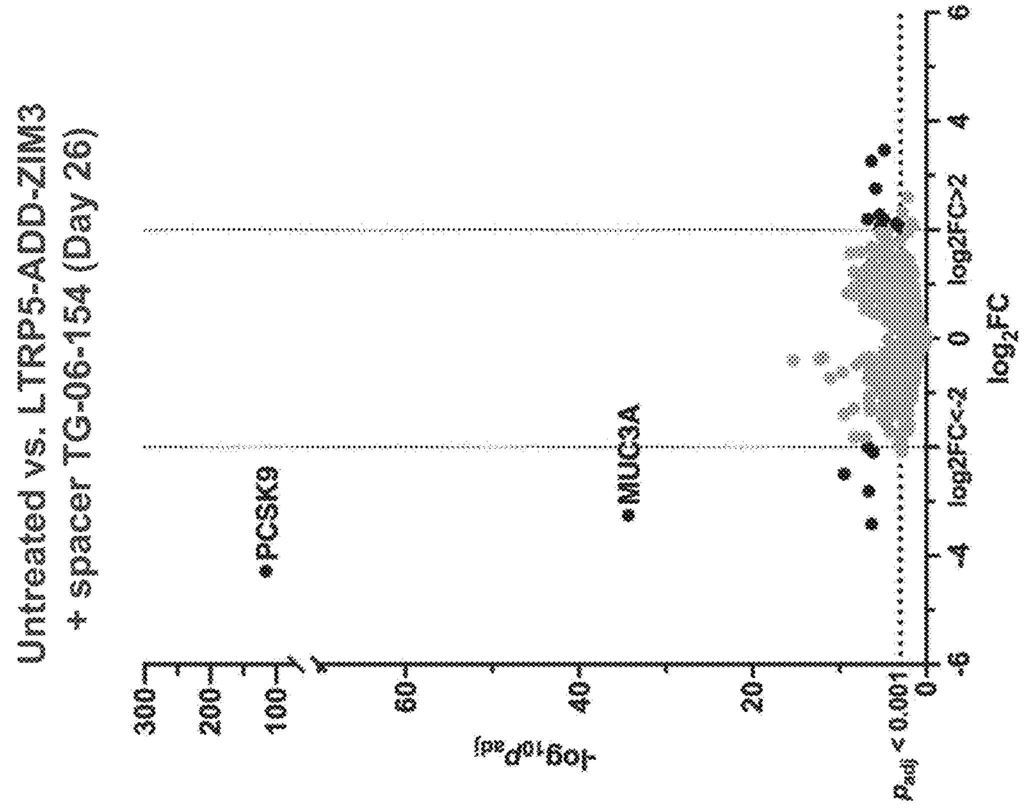
Figure 66A:
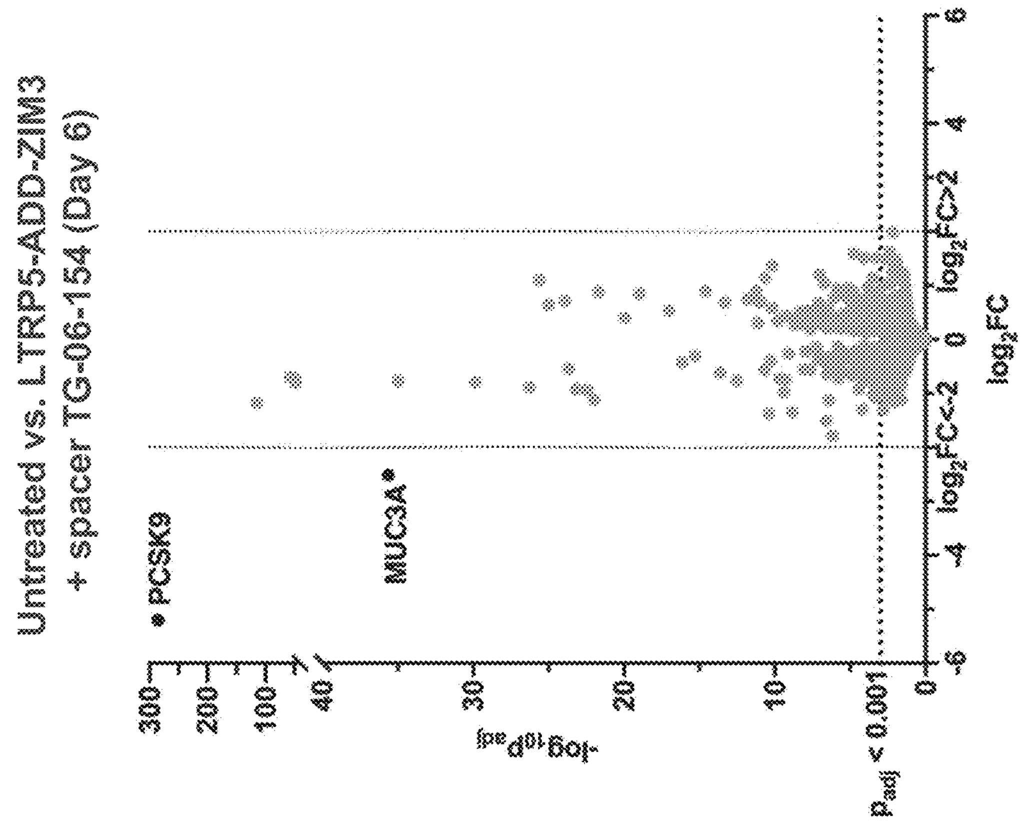

FIG. 66A is a volcano plot showing the differential gene expression analysis (log 2FC of read counts) comparing LTRP5-ADD-ZIM3 paired with spacer TG-06-154 with the untreated, naïve control at 6 days post-transfection. The horizontal dotted line shows the adjusted p<0.001, and the vertical lines show the |log 2FC|>2 threshold. Black dots (except for PCSK9) are the identified differentially regulated off-target genes after applying the two significance thresholds.

FIG. 66B is a volcano plot showing the differential gene expression analysis (log 2FC of read counts) comparing LTRP5-ADD-ZIM3 paired with spacer TG-06-154 with the untreated, naïve control at 26 days post-transfection. The horizontal dotted line shows the adjusted p<0.001, and the vertical lines show the |log 2FC|>2 threshold. Black dots (except for PCSK9) are the identified differentially regulated off-target genes after applying the two significance thresholds.

Figure 67A:
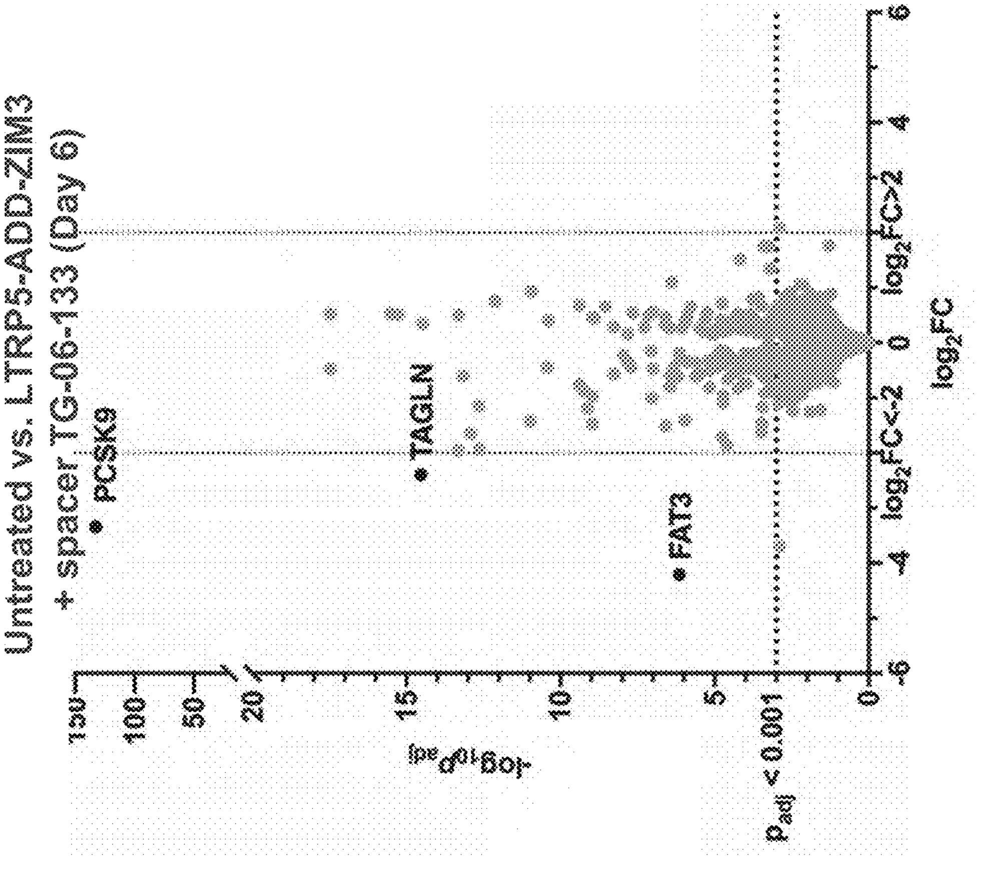

FIG. 67A is a volcano plot is a volcano plot showing the differential gene expression analysis (log 2FC of read counts) comparing LTRP5-ADD-ZIM3 paired with spacer TG-06-133 with the untreated, naïve control at 6 days post-transfection. The horizontal dotted line shows the adjusted p<0.001, and the vertical lines show the |log 2FC|>2 threshold. Black dots (except for PCSK9) are the identified differentially regulated off-target genes after applying the two significance thresholds.

Figure 67B:
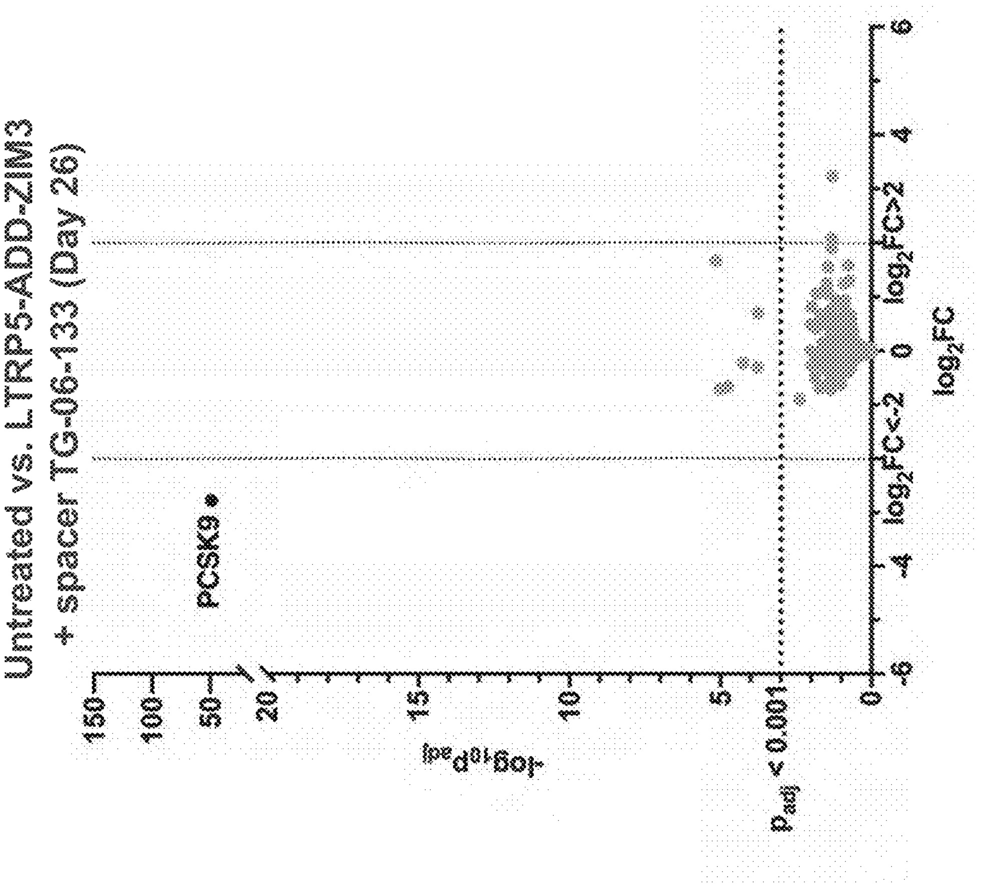

FIG. 67B is a volcano plot showing the differential gene expression analysis (log 2FC of read counts) comparing LTRP5-ADD-ZIM3 paired with spacer TG-06-133 with the untreated, naïve control at 26 days post-transfection. The horizontal dotted line shows the adjusted p<0.001, and the vertical lines show the |log 2FC|>2 threshold. Black dots (except for PCSK9) are the identified differentially regulated off-target genes after applying the two significance thresholds.

Figure 68:
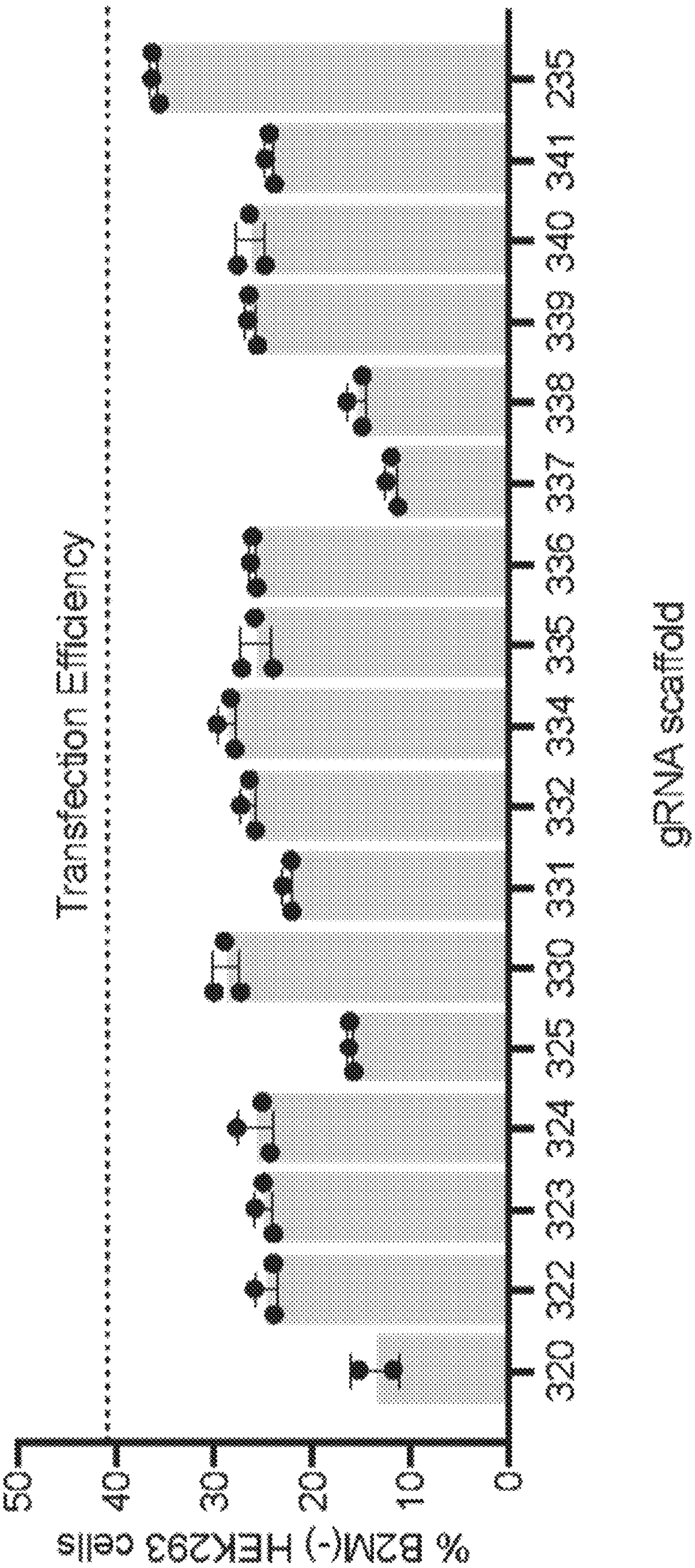

FIG. 68 is a bar graph showing the quantification of percent knockout of B2M in HEK293 cells transfected with CpG-depleted AAV plasmids containing the indicated gRNA scaffolds with spacer 7.37, as described in Example 24. The dotted line indicates ~41% transfection efficiency.

Figure 69A:
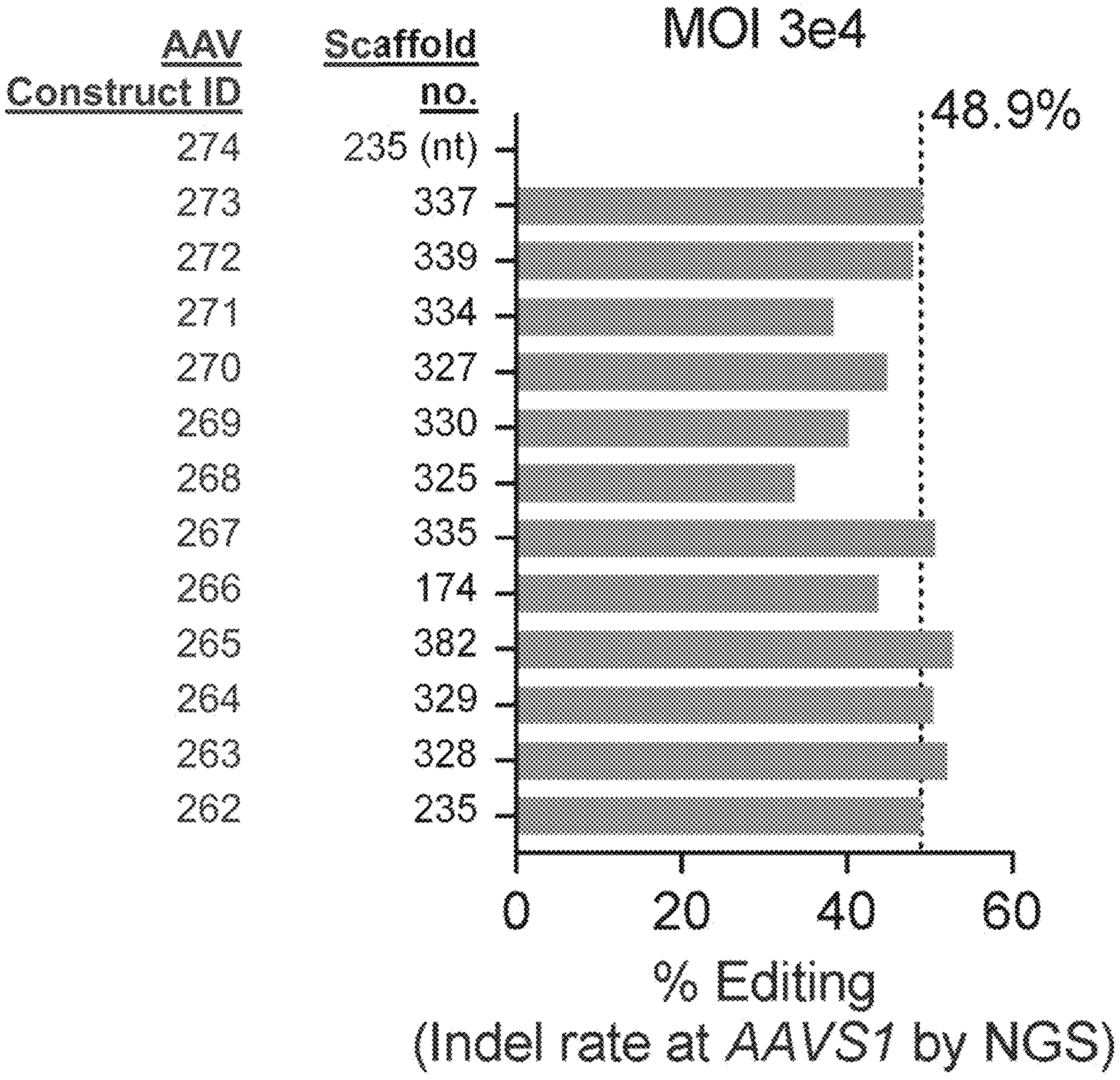

FIG. 69A is a bar plot showing percent editing at the AAVS1 locus in human induced neurons (iNs) transduced with AAVs expressing the CasX:gRNA system using the indicated gRNA scaffolds (AAV construct ID #262-274) at the MOI of 3E4 vg/cell, as described in Example 24.

Figure 69B:
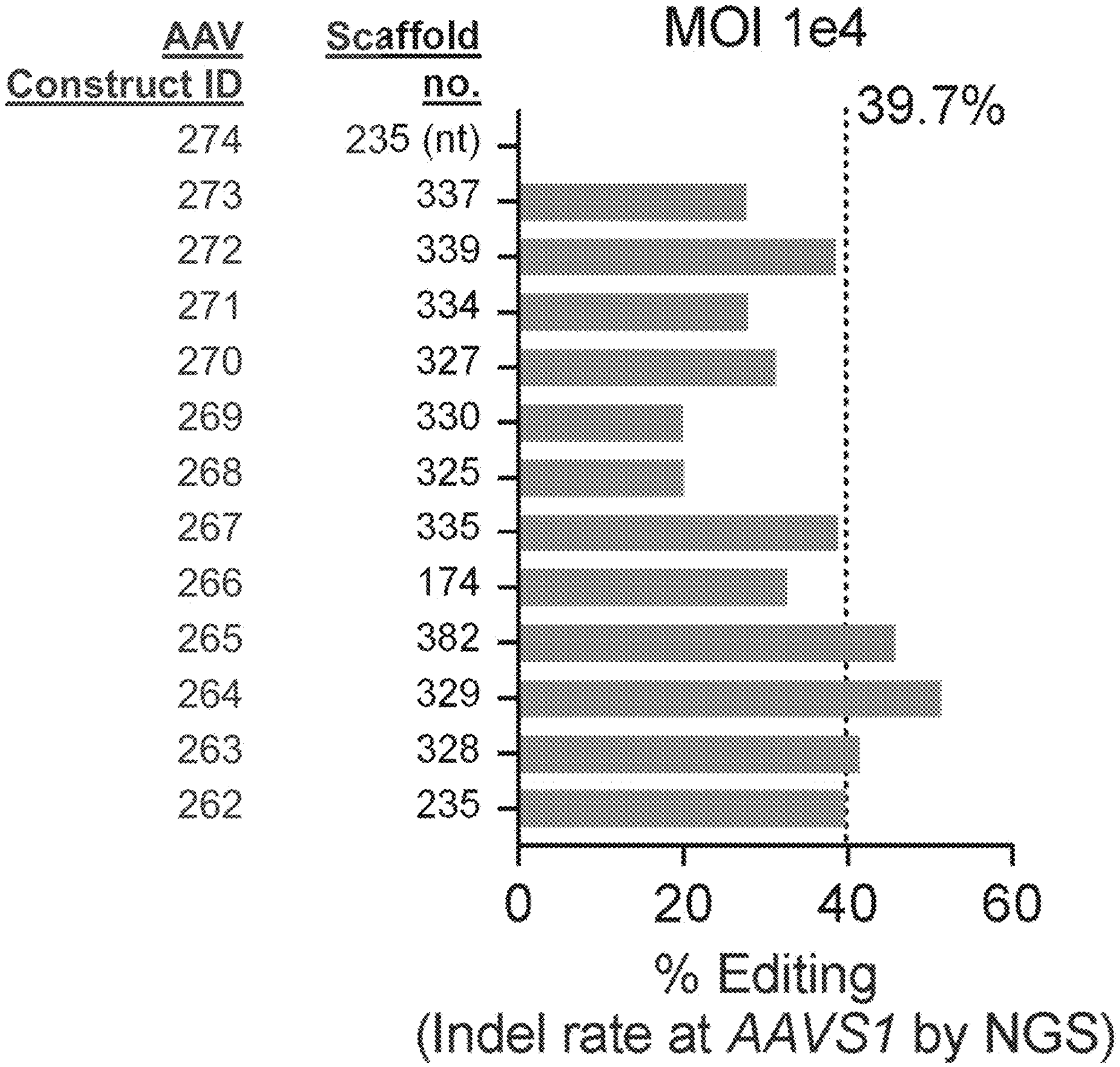

FIG. 69B is a bar plot showing percent editing at the AAVS1 locus in human iNs transduced with AAVs expressing the CasX:gRNA system using the indicated gRNA scaffolds (AAV construct ID #262-274) at the MOI of 1E4 vg/cell, as described in Example 24.

Figure 69C:
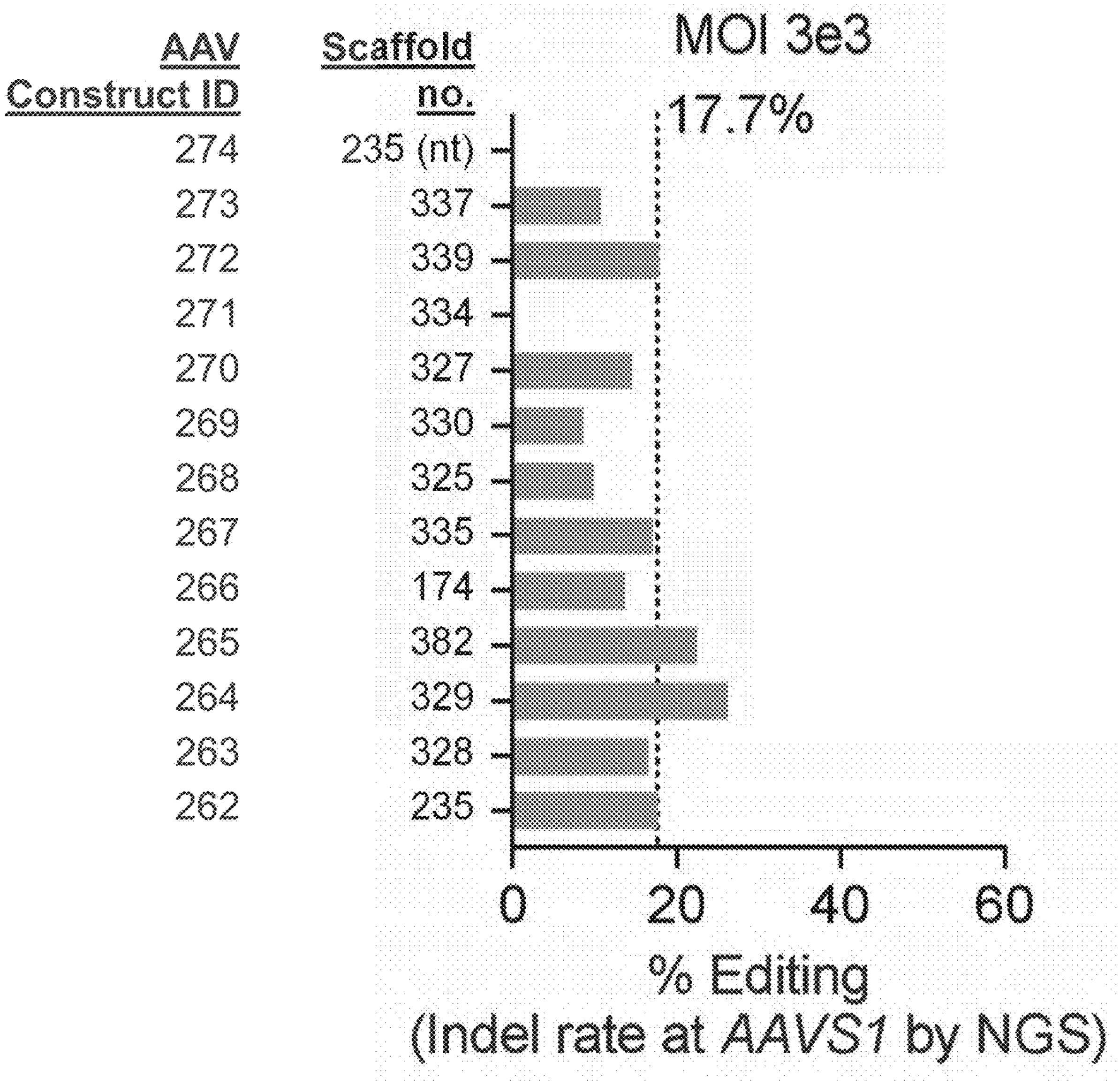

FIG. 69C is a bar plot showing percent editing at the AAVS1 locus in human iNs transduced with AAVs expressing the CasX:gRNA system using the indicated gRNA scaffolds (AAV construct ID #262-274) at the MOI of 3E3 vg/cell, as described in Example 24.

Figure 70A:
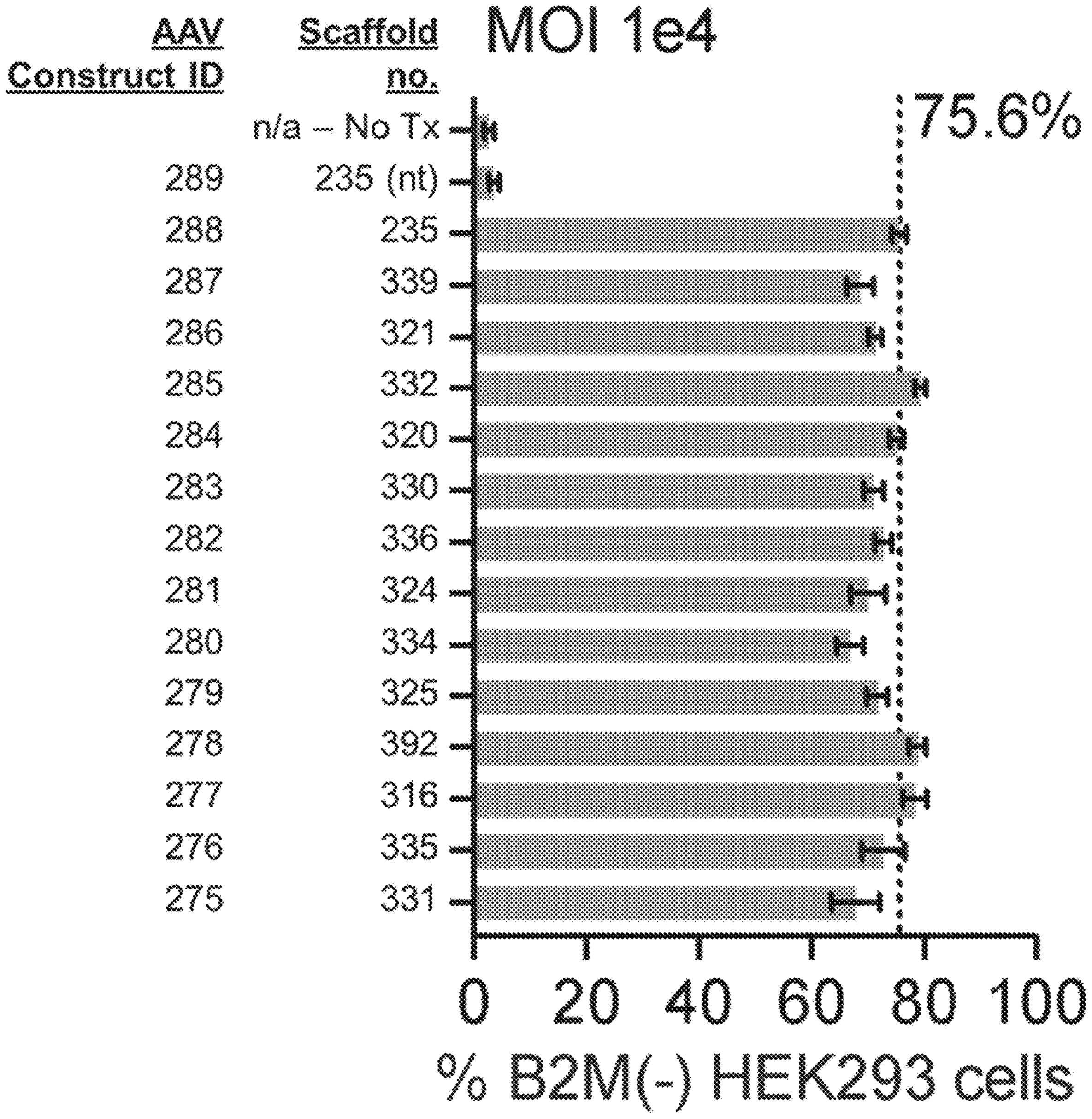

FIG. 70A is a bar plot showing the quantification of percent knockout of B2M in HEK293 cells transfected with CpG-depleted AAV plasmids containing the indicated gRNA scaffolds with spacer 7.37 (AAV construct ID #275-289) at the MOI of 1E4 vg/cell, as described in Example 24.

Figure 70B:
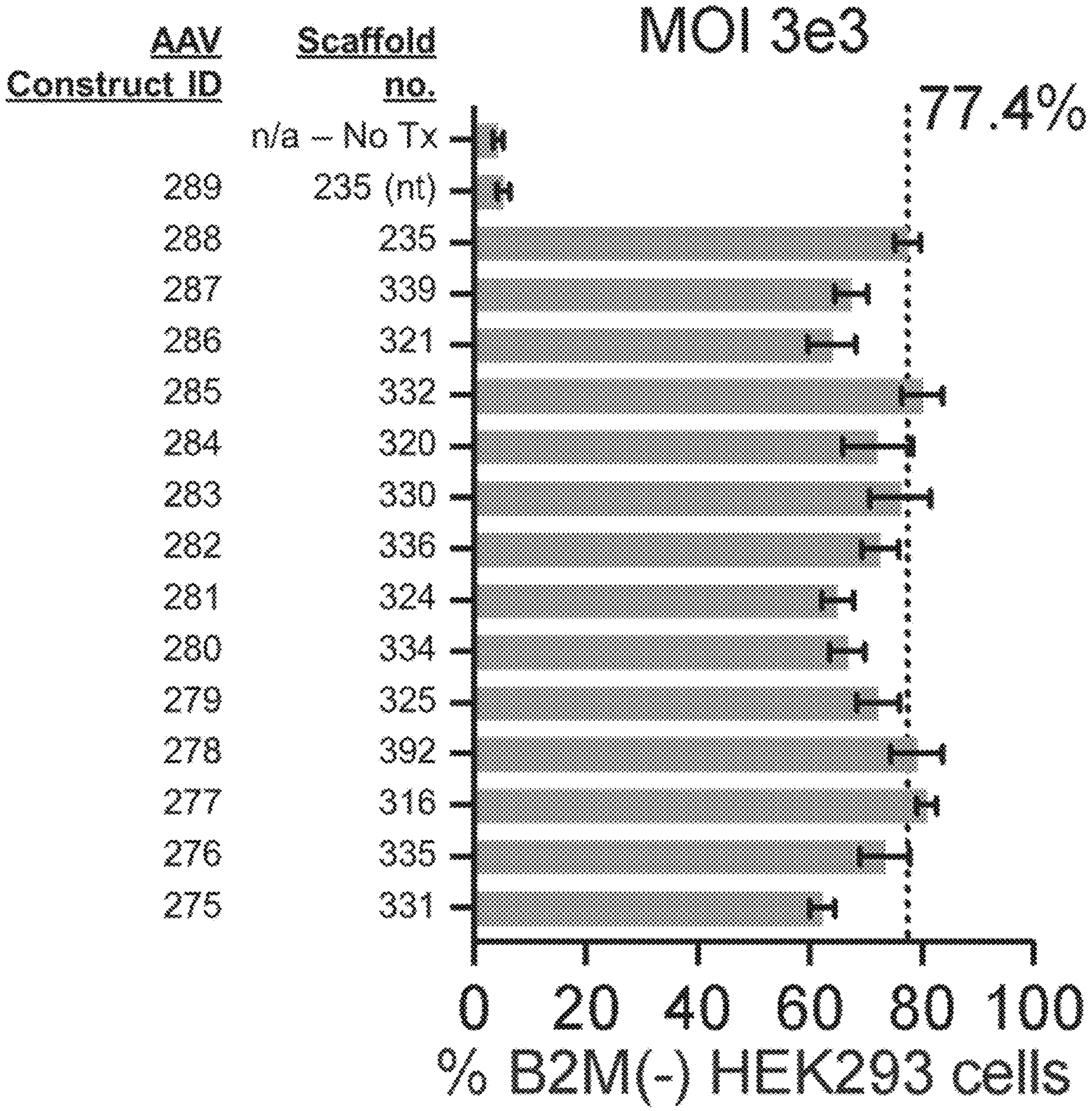

FIG. 70B is a bar plot showing the quantification of percent knockout of B2M in HEK293 cells transfected with CpG-depleted AAV plasmids containing the indicated gRNA scaffolds with spacer 7.37 (AAV construct ID #275-289) at the MOI of 3E3 vg/cell, as described in Example 24.

Figure 70C:
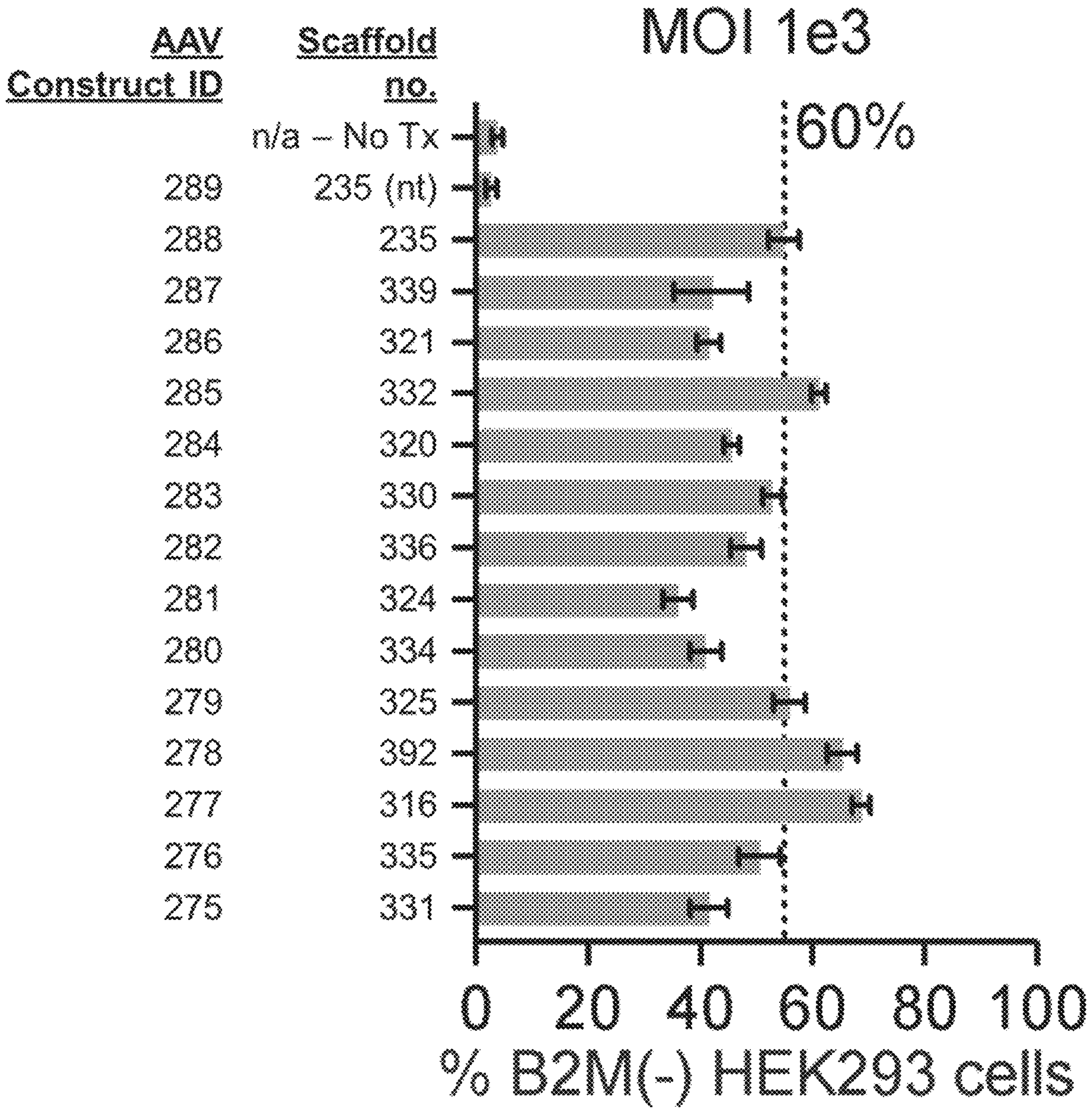

FIG. 70C is a bar plot showing the quantification of percent knockout of B2M in HEK293 cells transfected with CpG-depleted AAV plasmids containing the indicated gRNA scaffolds with spacer 7.37 (AAV construct ID #275-289) at the MOI of 1E3 vg/cell, as described in Example 24.

DETAILED DESCRIPTION

While exemplary embodiments have been shown and described herein, it will be obvious to those skilled in the art that such embodiments are provided by way of example only. Numerous variations, changes, and substitutions will now occur to those skilled in the art without departing from the inventions claimed herein. It should be understood that various alternatives to the embodiments described herein may be employed in practicing the embodiments of the disclosure. It is intended that the claims define the scope of the invention and that methods and structures within the scope of these claims and their equivalents be covered thereby.

Unless otherwise defined, all technical and scientific terms used herein have the same meaning as commonly understood by one of ordinary skill in the art to which this invention belongs. Although methods and materials similar or equivalent to those described herein can be used in the practice or testing of the present embodiments, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

"Hybridizable" or "complementary" are used interchangeably to mean that a nucleic acid (e.g., RNA, DNA) comprises a sequence of nucleotides that enables it to non-covalently bind, i.e., form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. It is understood that the sequence of a polynucleotide need not be 100% complementary to that of its target nucleic acid to be specifically hybridizable; it can have at least about 70%, at least about 80%, or at least about 90%, or at least about 95% sequence identity and still hybridize to the target nucleic acid. Moreover, a polynucleotide may hybridize over one or more segments such that intervening or adjacent segments are not involved in the hybridization event (e.g., a loop structure or hairpin structure, a 'bulge', 'bubble' and the like). Thus, the skilled artisan will understand that while individual bases within a sequence may not be complementary to another sequence, the sequence as a whole is still considered to be complementary.

A "gene," for the purposes of the present disclosure, includes a DNA region encoding a gene product (e.g., a protein, RNA), as well as all DNA regions which regulate the production of the gene product, whether or not such regulatory sequences are adjacent to coding and/or transcribed sequences. Accordingly, a gene may include accessory element sequences including, but not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. Coding sequences encode a gene product upon transcription or transcription and translation; the coding sequences of the disclosure may comprise fragments and need not contain a full-length open reading frame. A gene can include both the strand that is transcribed as well as the complementary strand containing the anticodons.

The term "downstream" refers to a nucleotide sequence that is located 3' to a reference nucleotide sequence. In certain embodiments, downstream nucleotide sequences relate to sequences that follow the starting point of transcription. For example, the translation initiation codon of a gene is located downstream of the start site of transcription.

The term "upstream" refers to a nucleotide sequence that is located 5' to a reference nucleotide sequence. In certain embodiments, upstream nucleotide sequences relate to sequences that are located on the 5' side of a coding region or starting point of transcription. For example, most promoters are located upstream of the start site of transcription.

The term "adjacent to" with respect to polynucleotide or amino acid sequences refers to sequences that are next to, or adjoining each other in a polynucleotide or polypeptide. The skilled artisan will appreciate that two sequences can be considered to be adjacent to each other and still encompass a limited amount of intervening sequence, e.g., 1, 2, 3, 4, 5, 6, 7, 8, 9 or 10 nucleotides or amino acids.

The term "regulatory element" is used interchangeably herein with the term "regulatory sequence," and is intended to include promoters, enhancers, and other expression regulatory elements. It will be understood that the choice of the appropriate regulatory element will depend on the encoded component to be expressed (e.g., protein or RNA) or whether the nucleic acid comprises multiple components that require different polymerases or are not intended to be expressed as a fusion protein.

The term "accessory element" is used interchangeably herein with the term "accessory sequence," and is intended to include, inter alia, polyadenylation signals (poly(A) signal), enhancer elements, introns, posttranscriptional regulatory elements (PTREs), nuclear localization signals (NLS), deaminases, DNA glycosylase inhibitors, additional promoters, factors that stimulate CRISPR-mediated homology-directed repair (e.g. in cis or in trans), self-cleaving sequences, and fusion domains, for example a fusion domain fused to a CRISPR protein. It will be understood that the choice of the appropriate accessory element or elements will depend on the encoded component to be expressed (e.g., protein or RNA) or whether the nucleic acid comprises multiple components that require different polymerases or are not intended to be expressed as a fusion protein.

The term "promoter" refers to a DNA sequence that contains a transcription start site and additional sequences to facilitate polymerase binding and transcription. Exemplary eukaryotic promoters include elements such as a TATA box, and/or B recognition element (BRE) and assists or promotes the transcription and expression of an associated transcribable polynucleotide sequence and/or gene (or transgene). A promoter can be synthetically produced or can be derived from a known or naturally occurring promoter sequence or another promoter sequence. A promoter can also include a chimeric promoter comprising a combination of two or more heterologous sequences to confer certain properties. A promoter of the present disclosure can include variants of promoter sequences that are similar in composition, but not identical to, other promoter sequence(s) known or provided herein. A promoter can be classified according to criteria relating to the pattern of expression of an associated coding or transcribable sequence or gene operably linked to the promoter, such as constitutive, developmental, tissue-specific, inducible, etc. A promoter can also be classified according to its strength. As used in the context of a promoter, "strength" refers to the rate of transcription of the gene controlled by the promoter. A "strong" promoter means the rate of transcription is high, while a "weak" promoter means the rate of transcription is relatively low.

A promoter of the disclosure can be a Polymerase II (Pol II) promoter. Polymerase II transcribes all protein coding and many non-coding genes. A representative Pol II promoter includes a core promoter, which is a sequence of about 100 base pairs surrounding the transcription start site, and serves as a binding platform for the Pol II polymerase and associated general transcription factors. The promoter may contain one or more core promoter elements such as the TATA box, BRE, Initiator (INR), motif ten element (MTE), downstream core promoter element (DPE), downstream core element (DCE), although core promoters lacking these elements are known in the art. All Pol II promoters are envisaged as within the scope of the instant disclosure.

A promoter of the disclosure can be a Polymerase III (Pol III) promoter. Pol III transcribes DNA to synthesize small ribosomal RNAs such as the 5S rRNA, tRNAs, and other small RNAs. Representative Pol III promoters use internal control sequences (sequences within the transcribed section of the gene) to support transcription, although upstream elements such as the TATA box are also sometimes used. All Pol III promoters are envisaged as within the scope of the instant disclosure.

The term "enhancer" refers to regulatory DNA sequences that, when bound by specific proteins called transcription factors, regulate the expression of an associated gene. Enhancers may be located in the intron of the gene, or 5' or 3' of the coding sequence of the gene. Enhancers may be proximal to the gene (i.e., within a few tens or hundreds of base pairs (bp) of the promoter), or may be located distal to the gene (i.e., thousands of bp, hundreds of thousands of bp, or even millions of bp away from the promoter). A single gene may be regulated by more than one enhancer, all of which are envisaged as within the scope of the instant disclosure.

As used herein, a "post-transcriptional regulatory element (PTRE, or TRE)," such as a hepatitis PTRE, refers to a DNA sequence that, when transcribed creates a tertiary structure capable of exhibiting post-transcriptional activity to enhance or promote expression of an associated gene operably linked thereto.

In the context of the present disclosure and with respect to a gene, "repress", "repression", "repressing", "inhibition of gene expression", "downregulation", and "silencing" are used interchangeably herein to refer to the inhibition or blocking of transcription of a gene or a portion thereof. Accordingly, repression of a gene can result in a decrease in production of a gene product. Examples of gene repression processes which decrease transcription include, but are not limited to, those which inhibit formation of a transcription initiation complex, those which decrease transcription initiation rate, those which decrease transcription elongation rate, those which decrease processivity of transcription and those which antagonize transcriptional activation (by, for example, blocking the binding of a transcriptional activator). Gene repression can constitute, for example, prevention of activation as well as inhibition of expression below an existing level. Transcriptional repression includes both reversible and irreversible inactivation of gene transcription; the latter can result from epigenetic modification of the gene.

"Repressor" or "repressor domain" are used interchangeably to refer to polypeptide factors that act as regulatory elements on DNA that inhibit, repress, or block transcription of DNA, resulting in repression of gene expression. In the context of the present disclosure, the linking of a repressor domain to DNA-binding protein that can, when bound to the target nucleic acid, prevent transcription from a promoter or otherwise inhibit the expression of a gene. Without wishing to be bound by theory, it is thought that transcriptional repressors can function by a variety of mechanisms, including physically blocking RNA polymerase passage by steric hindrance, altering the polymerase's post-translational modification state, modifying the epigenetic state of the nascent RNA, changing the epigenetic state of the DNA through methylation, changing the epigenetic state of the DNA through histone deacetylation or modulating nucleosome remodeling, or preventing enhancer-promoter interactions, thereby leading to gene silencing or a reduction in the level of gene expression.

"Long-term repressor protein" or "LTRP" is used interchangeably herein with "repressor fusion protein" and refers to a fusion protein comprising a DNA binding protein (or DNA binding domain of a protein) fused to one or more domains capable of repressing transcription of a target nucleic acid sequence. Optionally, the repressor fusion proteins of the disclosure may contain additional elements, such as linkers between any of the domains of the fusion protein, nuclear localization signals, nuclear export signals, as well as additional protein domains that confer additional activities upon the repressor fusion protein.

As used herein a "repressor fusion protein:gRNA system" is a system for transcriptional repression and comprises a repressor fusion protein comprising a catalytically-dead CRISPR protein and one or more linked repressor domains, and a guide nucleic acid (gRNA) that binds to the catalytically-dead CRISPR protein. For clarity, the system also includes any encoding DNA, RNA or vectors and the like that can be used to produce the repressor fusion proteins and gRNA components of the system.

As used herein, a DNA-binding protein refers to a protein, or domain of a protein, capable of binding to DNA. Exemplary DNA-binding proteins include zinc finger (ZF) proteins, TALEs, and CRISPR proteins. The skilled artisan will appreciate that in multi-functional proteins that are capable of both binding DNA and carrying out another activity such as DNA cleavage, such as, e.g., CRISPR proteins, the DNA binding function can be separated from the other functions of the protein, leading to catalytically-dead DNA binding proteins.

As used herein a "catalytically-dead CRISPR protein" refers to a CRISPR protein that lacks endonuclease activity. The skilled artisan will appreciate that a CRISPR protein can be catalytically-dead, and still able to carry out additional protein functions, such as DNA binding. Similarly, a "catalytically-dead CasX" refers to a CasX protein that lacks endonuclease activity but is still able to carry out additional protein functions, such as DNA binding.

"Recombinant," as used herein, means that a particular nucleic acid (DNA or RNA) is the product of various combinations of cloning, restriction, and/or ligation steps resulting in a construct having a structural coding or non-coding sequence distinguishable from endogenous nucleic acids found in natural systems. Generally, DNA sequences encoding the structural coding sequence can be assembled from cDNA fragments and short oligonucleotide linkers, or from a series of synthetic oligonucleotides, to provide a synthetic nucleic acid which is capable of being expressed from a recombinant transcriptional unit contained in a cell or in a cell-free transcription and translation system. Such sequences can be provided in the form of an open reading frame uninterrupted by internal non-translated sequences, or introns, which are typically present in eukaryotic genes. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions, and may indeed act to modulate production of a desired product by various mechanisms (see "enhancers" and "promoters", above).

The term "recombinant polynucleotide" or "recombinant nucleic acid" refers to one which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such is usually done to replace a codon with a redundant codon encoding the same or a conservative amino acid, while typically introducing or removing a sequence recognition site. Alternatively, it is performed to join together nucleic acid segments of desired functions to generate a desired combination of functions. This artificial combination is often accomplished by either chemical synthesis means, or by the artificial manipulation of isolated segments of nucleic acids, e.g., by genetic engineering techniques.

Similarly, the term "recombinant polypeptide" or "recombinant protein" refers to a polypeptide or protein which is not naturally occurring, e.g., is made by the artificial combination of two otherwise separated segments of amino sequence through human intervention. Thus, e.g., a protein that comprises a heterologous amino acid sequence is recombinant.

As used herein, "lipoprotein", such as VLDL, LDL and HDL, refers to a group of proteins found in the serum, plasma and lymph and are important for lipid transport. The chemical composition of each lipoprotein differs, for example, in that the HDL has a higher proportion of protein versus lipid, whereas the VLDL has a lower proportion of protein versus lipid.

As used herein, "atherosclerosis" means a hardening of the arteries affecting large and medium-sized arteries and is characterized by the presence of fatty deposits. The fatty deposits are called "atheromas" or "plaques," which consist mainly of cholesterol and other fats, calcium and scar tissue, and damage the lining of arteries.

As used herein, "coronary heart disease (CHD)" means a narrowing of the small blood vessels that supply blood and oxygen to the heart, which is often a result of atherosclerosis.

As used herein, "dyslipidemia" refers to a disorder of lipid and/or lipoprotein metabolism, including lipid and/or lipoprotein overproduction or deficiency. Dyslipidemias can be manifested by elevation of lipids such as chylomicron, cholesterol and triglycerides as well as lipoproteins such as low-density lipoprotein (LDL) cholesterol.

As used herein, "high density lipoprotein-C" or "HDL-C" means cholesterol associated with high-density lipoprotein particles. Concentration of HDL-C in serum (or plasma) is typically quantified in mg/dL or nmol/L. "Serum HDL-C" and "plasma HDL-C" mean HDL-C in serum and plasma, respectively.

As used herein, "low density lipoprotein-cholesterol (LDL-C)" means cholesterol carried in low density lipoprotein particles. Concentration of LDL-C in serum (or plasma) is typically quantified in mg/dL or nmol/L. "Serum LDL-C" and "plasma LDL-C" mean LDL-C in the serum and plasma, respectively.

As used herein, "hypercholesterolemia" means a condition characterized by elevated cholesterol or circulating (plasma) cholesterol, LDL-cholesterol and VLDL-cholesterol, as per the guidelines of the Expert Panel Report of the National Cholesterol Educational Program (NCEP) of Detection, Evaluation of Treatment of high cholesterol in adults (see, Arch. Int. Med. 148:36 (1988)).

As used herein, "hyperlipidemia" or "hyperlipemia" is a condition characterized by elevated serum lipids or circulating (plasma) lipids. This condition manifests an abnormally high concentration of fats. The lipid fractions in the circulating blood are cholesterol, low-density lipoproteins, very low density lipoproteins, chylomicrons and triglycerides. The Fredrickson classification of hyperlipidemias is based on the pattern of TG and cholesterol-rich lipoprotein particles, as measured by electrophoresis or ultracentrifugation and is commonly used to characterize primary causes of hyperlipidemias such as hypertriglyceridemia.

As used herein, "triglyceride" or "TG" means a lipid or neutral fat consisting of glycerol combined with three fatty acid molecules.

As used herein, "hypertriglyceridemia" means a condition characterized by elevated triglyceride levels. Its etiology includes primary (i.e. genetic causes) and secondary (other underlying causes such as diabetes, metabolic syndrome/insulin resistance, obesity, physical inactivity, cigarette smoking, excess alcohol and a diet very high in carbohydrates) factors or, most often, a combination of both As used herein, "diabetes mellitus" or "diabetes" is a syndrome characterized by disordered metabolism and abnormally high blood sugar (hyperglycemia) resulting from insufficient levels of insulin or reduced insulin sensitivity. The characteristic symptoms are excessive urine production (polyuria) due to high blood glucose levels, excessive thirst and increased fluid intake (polydipsia) attempting to compensate for increased urination, blurred vision due to high blood glucose effects on the eye's optics, unexplained weight loss, and lethargy.

As used herein, "diabetic dyslipidemia" or "type 2 diabetes with dyslipidemia" means a condition characterized by Type 2 diabetes, reduced HDL-C, elevated triglycerides (TG), and elevated small, dense LDL particles.

As used herein, "lipid nanoparticle" refers to particles having at least one dimension on the order of nanometers (e.g., 1-1,000 nm) comprising one or more lipids (e.g., cationic lipids, non-cationic lipids, and PEG-modified lipids). In some embodiments, lipid nanoparticles are included in a formulation that can be used to deliver an active agent or therapeutic agent, such as a nucleic acid (e.g., mRNA) to a target site of interest (e.g., cell, tissue, organ, tumor, and the like). In some embodiments, the lipid nanoparticles of the disclosure comprise a nucleic acid. Such lipid nanoparticles typically comprise neutral lipids, charged lipids, steroids and polymer conjugated lipids. In some embodiments, the active agent or therapeutic agent, such as a nucleic acid, may be encapsulated in the lipid portion of the lipid nanoparticle or an aqueous space enveloped by some or all of the lipid portion of the lipid nanoparticle, thereby protecting it from enzymatic degradation or other undesirable effects induced by the mechanisms of the host organism or cells e.g. an adverse immune response.

As used herein, "lipid encapsulated" refers to a lipid nanoparticle that provides an active agent or therapeutic agent, such as a nucleic acid (e.g., mRNA), with full encapsulation, partial encapsulation, or both. In an embodiment, the nucleic acid (e.g., mRNA) is fully encapsulated in the lipid nanoparticle.

As used herein, the term "contacting" means establishing a physical connection between two or more entities. For example, contacting a target nucleic acid with a guide nucleic acid means that the target nucleic acid and the guide nucleic acid are made to share a physical connection; e.g., can hybridize if the sequences share sequence similarity.

"Dissociation constant", or "$K_d$", are used interchangeably and mean the affinity between a ligand "L" and a protein "P"; i.e., how tightly a ligand binds to a particular protein. It can be calculated using the formula $K_d=[L][P]/[LP]$, where [P], [L] and [LP] represent molar concentrations of the protein, ligand and complex, respectively.

The disclosure provides compositions and methods useful for modifying a target nucleic acid. As used herein "editing" is used interchangeably with "modifying" and "modification" and includes but is not limited to, cleaving, nicking, editing, deleting, knocking in, knocking out, and the like. Modifying can also encompass epigenetic modifications to a nucleic acid, or chromatin containing the nucleic acid, such as, but not limited to, changes in DNA methylation, and histone methylation and acetylation.

By "cleavage" it is meant the breakage of the covalent backbone of a target nucleic acid molecule (e.g., RNA, DNA). Cleavage can be initiated by a variety of methods including, but not limited to, enzymatic or chemical hydrolysis of a phosphodiester bond. Both single-stranded cleavage and double-stranded cleavage are possible, and double-stranded cleavage can occur as a result of two distinct single-stranded cleavage events.

The term "knock-down" as used herein refers to reduction in the expression of a gene or its gene product(s). As a result of a gene knock-down, the protein activity or function may be attenuated or the protein levels may be reduced or eliminated.

A polynucleotide or polypeptide has a certain percent "sequence similarity" or "sequence identity" to another polynucleotide or polypeptide, meaning that, when aligned, that percentage of bases or amino acids are the same, and in the same relative position, when comparing the two sequences. Sequence similarity (sometimes referred to as percent similarity, percent identity, or homology) can be determined in a number of different manners. To determine sequence similarity, sequences can be aligned using the methods and computer programs that are known in the art, including BLAST, available over the world wide web at ncbi.nlm.nih.gov/BLAST. Percent complementarity between particular stretches of nucleic acid sequences within nucleic acids can be determined using any convenient method. Example methods include BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), e.g., using default settings, which uses the algorithm of Smith and Waterman (Adv. Appl. Math., 1981, 2, 482-489).

The terms "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones. The term includes fusion proteins, including, but not limited to, fusion proteins with a heterologous amino acid sequence.

A "vector" or "expression vector" is a replicon, such as plasmid, phage, virus, or cosmid, to which another DNA segment, i.e., an expression cassette, may be attached so as to bring about the replication or expression of the attached segment in a cell.

The term "naturally-occurring" or "unmodified" or "wild type" as used herein as applied to a nucleic acid, a polypeptide, a cell, or an organism, refers to a nucleic acid, polypeptide, cell, or organism that is found in nature.

As used herein, a "mutation" refers to an insertion, deletion, substitution, duplication, or inversion of one or more amino acids or nucleotides as compared to a wild-type or reference amino acid sequence or to a wild-type or reference nucleotide sequence.

As used herein the term "isolated" is meant to describe a polynucleotide, a polypeptide, or a cell that is in an environment different from that in which the polynucleotide, the polypeptide, or the cell naturally occurs. An isolated genetically modified host cell may be present in a mixed population of genetically modified host cells.

A "host cell," as used herein, denotes a eukaryotic cell, a prokaryotic cell, or a cell from a multicellular organism (e.g., a cell line) cultured as a unicellular entity, which eukaryotic or prokaryotic cells are used as recipients for a nucleic acid (e.g., an AAV vector), and include the progeny of the original cell which has been genetically modified by the nucleic acid. It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host cell into which has been introduced a heterologous nucleic acid, e.g., an AAV vector.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide-containing side chains consists of asparagine and glutamine; a group of amino acids having aromatic side chains consists of phenylalanine, tyrosine, and tryptophan; a group of amino acids having basic side chains consists of lysine, arginine, and histidine; and a group of amino acids having sulfur-containing side chains consists of cysteine and methionine. Exemplary conservative amino acid substitution groups are: valine-leucine-isoleucine, phenylalanine-tyrosine, lysine-arginine, alanine-valine, and asparagine-glutamine.

As used herein, "treatment" or "treating," are used interchangeably herein and refer to an approach for obtaining beneficial or desired results, including but not limited to a therapeutic benefit and/or a prophylactic benefit. By therapeutic benefit is meant eradication or amelioration of the underlying disorder or disease being treated. A therapeutic benefit can also be achieved with the eradication or amelioration of one or more of the symptoms or an improvement in one or more clinical parameters associated with the underlying disease such that an improvement is observed in the subject, notwithstanding that the subject may still be afflicted with the underlying disorder.

The terms "therapeutically effective amount" and "therapeutically effective dose", as used herein, refer to an amount of a drug or a biologic, alone or as a part of a composition, that is capable of having any detectable, beneficial effect on any symptom, aspect, measured parameter or characteristics of a disease state or condition when administered in one or repeated doses to a subject such as a human or an experimental animal. Such effect need not be absolute to be beneficial.

As used herein, "administering" means a method of giving a dosage of a compound (e.g., a composition of the disclosure) or a composition (e.g., a pharmaceutical composition) to a subject.

A "subject" is a mammal. Mammals include, but are not limited to, domesticated animals, non-human primates, humans, dogs, rabbits, mice, rats and other rodents.

The term "low-density lipoprotein (LDL)" refers to one of the five major groups of lipoprotein, from least dense (lower weight-volume ratio particles) to most dense (larger weight-volume ratio particles): chylomicrons, very low-density lipoproteins (VLDL), low-density lipoproteins (LDL), intermediate-density lipoproteins (IDL), and high-density lipoproteins (HDL). Lipoproteins transfer lipids (fats) around the body in the extracellular fluid thereby facilitating the transfer of fats to the cells body via receptor-mediated endocytosis. An LDL particle is about 220-275 angstroms in diameter.

"Low-density lipoprotein (LDL) receptor" refers to a receptor protein of 839 amino acids (after removal of 21-amino acid signal peptide) that mediates the endocytosis of cholesterol-rich LDL particles. It is a cell-surface receptor that recognizes the apoprotein B100 and apoE protein found in chylomicron remnants and VLDL remnants (IDL) resulting in the binding and endocytosis of LDL-cholesterol. This process occurs in all nucleated cells, but mainly in the liver which removes approximately 70% of LDL from the circulation. The human LDLR gene is described in part in the NCBI database (ncbi.nlm.nih.gov) as Reference Sequence NG_009060.1, which is incorporated by reference herein.

All publications, patents, and patent applications mentioned in this specification are herein incorporated by reference to the same extent as if each individual publication, patent, or patent application was specifically and individually indicated to be incorporated by reference. The contents of WO 2020/247882, filed on Jun. 5, 2020, WO 2020/247883, filed Jun. 5, 2020, WO 2021/050593, filed on Sep.

9, 2020, WO 2021/050601, filed on Sep. 9, 2021, WO 2021/142342, filed on Jan. 8, 2021, WO 2021/113763, filed on Dec. 4, 2020, WO 2021/113769, filed on Dec. 4, 2020, WO 2021/113772, filed on Dec. 4, 2020, WO 2021/188729, filed on Dec. 4, 2020, WO 2022/120095, filed Dec. 2, 2021, WO 2022/120094, filed on Dec. 2, 2021, WO 2022/125843, filed on Dec. 9, 2021, WO 2022/120089, filed on Dec. 2, 2021, WO 2022/261150, filed on Jun. 7, 2022, WO 2023/049742, filed on Sep. 21, 2022, WO 2022/261149, filed on Jun. 7, 2022, and PCT/US2023/067791, filed on Jun. 1, 2023, which disclose CasX variants and gRNA variants, and methods of delivering same, are hereby incorporated by reference in their entirety.

I. General Methods

The practice of the present invention employs, unless otherwise indicated, conventional techniques of immunology, biochemistry, chemistry, molecular biology, microbiology, cell biology, genomics and recombinant DNA, which can be found in such standard textbooks as Molecular Cloning: A Laboratory Manual, 3rd Ed. (Sambrook et al., Harbor Laboratory Press 2001); Short Protocols in Molecular Biology, $4^{th}$ Ed. (Ausubel et al. eds., John Wiley & Sons 1999); Protein Methods (Bollag et al., John Wiley & Sons 1996); Nonviral Vectors for Gene Therapy (Wagner et al. eds., Academic Press 1999); Viral Vectors (Kaplift & Loewy eds., Academic Press 1995); Immunology Methods Manual (I. Lefkovits ed., Academic Press 1997); and Cell and Tissue Culture: Laboratory Procedures in Biotechnology (Doyle & Griffiths, John Wiley & Sons 1998), the disclosures of which are incorporated herein by reference.

Where a range of values is provided, it is understood that endpoints are included and that each intervening value, to the tenth of the unit of the lower limit unless the context clearly dictates otherwise, between the upper and lower limit of that range and any other stated or intervening value in that stated range, is encompassed. The upper and lower limits of these smaller ranges may independently be included in the smaller ranges, and are also encompassed, subject to any specifically excluded limit in the stated range. Where the stated range includes one or both of the limits, ranges excluding either or both of those included limits are also included.

Unless defined otherwise, all technical and scientific terms used herein have the same meaning as commonly understood by one of ordinary skill in the art to which this invention belongs. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise.

It will be appreciated that certain features of the disclosure, which are, for clarity, described in the context of separate embodiments, may also be provided in combination in a single embodiment. In other cases, various features of the disclosure, which are, for brevity, described in the context of a single embodiment, may also be provided separately or in any suitable sub-combination. It is intended that all combinations of the embodiments pertaining to the disclosure are specifically embraced by the present disclosure and are disclosed herein just as if each and every combination was individually and explicitly disclosed. In addition, all sub-combinations of the various embodiments and elements thereof are also specifically embraced by the present disclosure and are disclosed herein just as if each and every such sub-combination was individually and explicitly disclosed herein.

II. Systems for Epigenetic Modification and Repression of PCSK9 Genes

In a first aspect, the present disclosure provides systems comprising or encoding a fusion protein comprising a DNA-binding protein and linked repressor domains capable of binding a target nucleic acid sequence of a PCSK9 gene targeted for transcriptional repression, silencing, and/or epigenetic modification (collectively, long-term repressor proteins, referred to herein as "LTRP" or "LTRP fusion protein" or "repressor fusion protein"; a reflection of the long-term repression effects that can be achieved on the targeted gene). As used herein, a "system" is used interchangeably with "composition". The disclosure also provides nucleic acids encoding the systems provided herein. Also provided herein are methods of making the systems, as well as methods of using the systems, including methods of gene repression and/or epigenetic modification and methods of treatment of PCSK9-related diseases.

In some embodiments, the DNA-binding proteins comprise zinc finger (ZF) or TALE (transcription-activator-like effector) proteins, or DNA binding domains thereof, also referred to herein as a DNA-binding protein, that bind but do not cleave the target nucleic acid. The DNA-binding domain of a TALE is comprised of a tandem array of 33-34 amino acid (aa)-long customizable monomers that theoretically can be assembled to recognize any genetic sequence following a one-repeat-binds-one-base-pair recognition code (Jain, S., et al. TALE outperforms Cas9 in editing heterochromatin target sites. Nat. Commun. 12:606 (2021)). The specificity of TALEs for binding DNA arises from two polymorphic amino acids, the so-called repeat variable diresidues (RVDs) located at positions 12 and 13 of a repeated unit. By re-arranging the repeats, the DNA binding specificities of TALE can be changed at will. Zinc finger proteins are transcription factors, where each finger recognizes 3-4 bases of DNA. By mixing and matching these finger modules, the ZFs can be customized for the sequence to be targeted. Exemplary ZFs that are capable of binding the PCSK9 gene are described in WO2018049009A2.

In some embodiments, the DNA-binding protein is a catalytically-dead Class 1 or Class 2 CRISPR protein. Catalytically-dead CRISPR proteins are also referred to in the art as "catalytically inactive" CRISPR proteins. In some embodiments, the Class 2, Type II protein is a catalytically-dead Cas9. In other embodiments, the Class 2 CRISPR protein is selected from the group consisting of a Type II, Type V, or Type VI protein. In one embodiment, the Class 2 Type V protein is selected from the group consisting of Cas12a (Cpf1), Cas12b (C2c1), Cas12c (C2c3), Cas12d (CasY), Cas12e (CasX), Cas12f, Cas12g, Cas12h, Cas12i, Cas12j, Cas12k, Cas14, and/or CasΦ, in each case rendered catalytically-dead by specific mutations, as described herein. In some embodiments, the CasX protein is a catalytically-dead CasX variant (dCasX), wherein the dCasX comprises a sequence selected from the group consisting of SEQ ID NOS: 4-29, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto, wherein the fusion protein comprising the dCasX retains the ability to form an RNP with a gRNA. In some embodiments, the dCasX comprises a sequence selected from the group consisting of SEQ ID NOS: 4-29. In some embodiments, the dCasX comprises a sequence selected from the group consisting of SEQ ID NOS: 3281-3441, comprising a RuvC domain with one or more mutations that inactivates the cleavage activity of the RuvC domain, thereby rendering the CasX protein catalytically dead. In a particular embodiment, the dCasX comprises a sequence of SEQ ID NO: 4.

The CRISPR-based systems further comprise a guide nucleic acid (gNA), for example a guide ribonucleic acid (gRNA) with a targeting sequence complementary to the target sequence of a gene. Upon binding of the target sequence by the CRISPR-based system, (the CRISPR protein and linked repressor domains) and the gRNA, transcription the gene is repressed.

The present disclosure provides systems for transcriptional repression of a PCSK9 gene. In some embodiments, the system comprises a repressor fusion protein comprising a catalytically-dead CasX protein and linked repressor domains, and a guide ribonucleic acid (gRNA) comprising a targeting sequence complementary to a target nucleic acid sequence of a PCSK9 gene targeted for repression, silencing, or downregulation (a repressor fusion protein:gRNA system). In some embodiments, the system comprises nucleic acids encoding the repressor fusion protein, for example a dCasX and linked repressor domains, and gRNA. In some embodiments, the system comprises a repressor fusion protein and a gRNA as gene repressor pairs that are capable of forming a ribonucleoprotein (RNP) complex and binding a PCSK9 target nucleic acid in a eukaryotic cell. In other cases, the disclosure provides systems of nucleic acids encoding the repressor fusion protein and gRNA, or a gRNA and an mRNA encoding the repressor fusion protein for use in certain particle formulations (e.g., an LNP) described herein.

Also provided herein are methods of making repressor fusion proteins and gRNAs, as well as methods of using the repressor fusion protein:gRNA systems, including methods of gene repression and/or epigenetic modification, and methods of treatment. The DNA-binding proteins (e.g., dCasX) and linked repressor domain(s) and gRNA components of the systems and their features, as well as the delivery modalities and the methods of using the systems for the repression, down-regulation or silencing of a PCSK9 gene are described more fully, below.

The disclosure provides systems specifically designed to repress or silence transcription of the PCSK9 gene. In some cases, the system is designed to repress transcription of the PCSK9 gene in eukaryotic cells having a gain of function mutation. In some cases, the system is designed to repress transcription of the wild-type PCSK9 gene in eukaryotic cells. In the alternative, the system is designed to repress transcription of a mutant allele of the PCSK9 gene in eukaryotic cells. Generally, any portion of the PCSK9 gene can be targeted using the programable systems and methods provided herein, described more fully, herein.

The PCSK9 gene encodes proprotein convertase subtilisin/kexin Type 9 ("PCSK9"), a protein that binds to the receptor for low-density lipoprotein particles (LDL) for transport of LDL into the cell. The PCSK9 gene encompasses the sequence that spans chr1:55,039,476-55,064,853 of the human genome (GRCh38/hg38) (the notation refers to the chromosome 1 (chr1), starting at the 55,039,476 bp to 55,064,853 bp on chromosome 1 (*Homo sapiens* Updated Annotation Release 109.20190905, GRCh38.p13) (NCBI). The human PCSK9 gene is described in part in the NCBI database (ncbi.nlm.nih.gov) as Reference Sequence NG_009061.1, which is incorporated by reference herein. The PCSK9 locus has 12 exons that produces an mRNA of 3636 bp encoding a 692-amino acid protein that, following its synthesis, undergoes an autocatalytic cleavage reaction that clips off the prodomain, resulting in an activated protein having 540 amino acids. The prodomain remains attached to the catalytic and resistin-like domains, likely because the prodomain serves as a chaperone and facilitates folding and secretion (Seidah, N G et al., Proc Natl Acad Sci USA 100(3):928 (2003)). The secretory proprotein convertase neural apoptosis-regulated convertase 1 (NARC-1): liver regeneration and neuronal differentiation (Seidah N G, et al.). This protein, also called neural apoptosis regulated convertase, is a serine protease belonging to the protease K subfamily of subtilases.

The human PCSK9 gene (HGNC: 20001) encodes a protein (Q8NBP7) having the sequence (SEQ ID NO: 1823)

```
MGTVSSRRSWWPLPLLLLLLLLLGPAGARAQEDEDGDYEELVLALRSEEDGLAEAPEHGTTATFHRCAKDP
WRLPGTYVVVLKEETHLSQSERTARRLQAQAARRGYLTKILHVFHGLLPGFLVKMSGDLLELALKLPHVDY
IEEDSSVFAQSIPWNLERITPPRYRADEYQPPDGGSLVEVYLLDTSIQSDHREIEGRVMVTDFENVPEEDG
TRFHRQASKCDSHGTHLAGVVSGRDAGVAKGASMRSLRVLNCQGKGTVSGTLIGLEFIRKSQLVQPVGPLV
VLLPLAGGYSRVLNAACQRLARAGVVLVTAAGNERDDACLYSPASAPEVITVGATNAQDQPVTLGTLGTNF
GRCVDLFAPGEDIIGASSDCSTCFVSQSGTSQAAAHVAGIAAMMLSAEPELTLAELRQRLIHFSAKDVINE
AWFPEDQRVLTPNLVAALPPSTHGAGWQLFCRTVWSAHSGPTRMATAVARCAPDEELLSCSSFSRSGKRRG
ERMEAQGGKLVCRAHNAFGGEGVYAIARCCLLPQANCSVHTAPPAEASMGTRVHCHQQGHVLTGCSSHWEV
EDLGTHKPPVLRPRGQPNQCVGHREASIHASCCHAPGLECKVKEHGIPAPQEQVTVACEEGWTLTGCSALP
GTSHVLGAYAVDNTCVVRSRDVSTTGSTSEGAVTAVAICCRSRHLAQASQELQ.
```

III. Catalytically-Dead Proteins for Use in the Repressor Systems

In some embodiments, the DNA-binding proteins for use in the fusion proteins, systems and methods of the disclosure are zinc finger (ZF) or TALE (transcription-activator-like effector) proteins that can bind, but not cleave, a PCSK9 target nucleic acid.

In some embodiments, the DNA-binding protein is a catalytically-dead Class 1 or Class 2 CRISPR protein. In one embodiment, the Class 2, Type II protein is a catalytically-dead Cas9. In another embodiment, the Class 2 CRISPR protein is selected from the group consisting of a Type II, Type V, or Type VI protein. In one embodiment, the Class 2 CRISPR Type V protein is selected from the group consisting of Cas12a (Cpf1), Cas12b (C2c1), Cas12c (C2c3), Cas12d (CasY), Cas12e (CasX), Cas12f, Cas12g, Cas12h, Cas12i, Cas12j, Cas12k, Cas14, and/or CasΦ, in each case rendered catalytically-dead by specific mutations, as described herein. In some embodiments, the CasX protein is a catalytically-dead CasX variant (dCasX).

The term "CasX protein", as used herein, refers to a family of proteins, and encompasses all naturally-occurring CasX proteins ("reference CasX"), as well as engineered CasX proteins with multiple sequence modifications, in addition to those rendering the CasX catalytically-dead (dCasX), that possess one or more improved characteristics relative to a reference CasX protein, described more fully, below. CasX proteins of the disclosure comprise the following domains: a non-target strand binding (NTSB) domain, a target strand loading (TSL) domain, a helical I domain, a helical II domain, an oligonucleotide binding domain (OBD), and a RuvC domain, and, in some cases, domains can be further divided into subdomains, as listed in Table 1.

In the context of the present disclosure, the CasX for use in the repressor fusion proteins, systems and methods are catalytically-dead (dCasX); achieved by mutations introduced at select locations in the RuvC sequence, described below.

a. Reference CasX Proteins

The disclosure provides naturally-occurring CasX proteins (referred to herein as a "reference CasX protein"), which were subsequently modified to create the engineered dCasX of the disclosure. For example, reference CasX proteins can be isolated from naturally occurring prokaryotes, such as Deltaproteobacteria, Planctomycetes, or Candidatus Sungbacteria species. A reference CasX protein (interchangeably referred to herein as a reference CasX polypeptide) is a Class 2, Type V CRISPR/Cas endonuclease belonging to the CasX (interchangeably referred to as Cas12e) family of proteins that interacts with a guide RNA to form a ribonucleoprotein (RNP) complex.

In some cases, a reference CasX protein is isolated or derived from Deltaproteobacter having a sequence of:

```
                                                          (SEQ ID NO: 1)
  1  MEKRINKIRK KLSADNATKP VSRSGPMKTL LVRVMTDDLK KRLEKRRKKP EVMPQVISNN
 61  AANNLRMLLD DYTKMKEAIL QVYWQEFKDD HVGLMCKFAQ PASKKIDQNK LKPEMDEKGN
121  LTTAGFACSQ CGQPLFVYKL EQVSEKGKAY TNYFGRCNVA EHEKLILLAQ LKPEKDSDEA
181  VTYSLGKFGQ RALDFYSIHV TKESTHPVKP LAQIAGNRYA SGPVGKALSD ACMGTIASFL
241  SKYQDIIIEH QKVVKGNQKR LESLRELAGK ENLEYPSVTL PPQPHTKEGV DAYNEVIARV
301  RMWVNLNLWQ KLKLSRDDAK PLLRLKGFPS FPVVERRENE VDWWNTINEV KKLIDAKRDM
361  GRVFWSGVTA EKRNTILEGY NYLPNENDHK KREGSLENPK KPAKRQFGDL LLYLEKKYAG
421  DWGKVEDEAW ERIDKKIAGL TSHIEREEAR NAEDAQSKAV LTDWLRAKAS FVLERLKEMD
481  EKEFYACEIQ LQKWYGDLRG NPFAVEAENR VVDISGFSIG SDGHSIQYRN LLAWKYLENG
541  KREFYLLMNY GKKGRIRFTD GTDIKKSGKW QGLLYGGGKA KVIDLTEDPD DEQLIILPLA
601  FGTRQGREFI WNDLLSLETG LIKLANGRVI EKTIYNKKIG RDEPALFVAL TFERREVVDP
661  SNIKPVNLIG VDRGENIPAV IALTDPEGCP LPEFKDSSGG PTDILRIGEG YKEKQRAIQA
721  AKEVEQRRAG GYSRKFASKS RNLADDMVRN SARDLFYHAV THDAVLVFEN LSRGFGRQGK
781  RTFMTERQYT KMEDWLTAKL AYEGLTSKTY LSKTLAQYTS KTCSNCGFTI TTADYDGMLV
841  RLKKTSDGWA TTLNNKELKA EGQITYYNRY KRQTVEKELS AELDRLSEES GNNDISKWTK
901  GRRDEALFLL KKRFSHRPVQ EQFVCLDCGH EVHADEQAAL NIARSWLFLN SNSTEFKSYK
961  SGKQPFVGAW QAFYKRRLKE VWKPNA.
```

In some cases, a reference CasX protein is isolated or derived from Planctomycetes having a sequence of:

```
                                                          (SEQ ID NO: 2)
  1  MQEIKRINKI RRRLVKDSNT KKAGKTGPMK TLLVRVMTPD LRERLENLRK KPENIPQPIS
 61  NTSRANLNKL LTDYTEMKKA ILHVYWEEFQ KDPVGLMSRV AQPAPKNIDQ RKLIPVKDGN
121  ERLTSSGFAC SQCCQPLYVY KLEQVNDKGK PHTNYFGRCN VSEHERLILL SPHKPEANDE
181  LVTYSLGKFG QRALDFYSIH VTRESNHPVK PLEQIGGNSC ASGPVGKALS DACMGAVASE
241  LTKYQDIILE HQKVIKKNEK RLANLKDIAS ANGLAFPKIT LPPQPHTKEG IEAYNNVVAQ
301  IVIWVNLNLW QKLKIGRDEA KPLQRLKGFP SFPLVERQAN EVDWWDMVCN VKKLINEKKE
```

-continued

```
361 DGKVFWQNLA GYKRQEALLP YLSSEEDRKK GKKFARYQFG DLLLHLEKKH GEDWGKVYDE

421 AWERIDKKVE GLSKHIKLEE ERRSEDAQSK AALTDWLRAK ASFVIEGLKE ADKDEFCRCE

481 LKLQKWYGDL RGKPFAIEAE NSILDISGES KQYNCAFIWQ KDGVKKLNLY LIINYFKGGK

541 LRFKKIKPEA FEANRFYTVI NKKSGEIVPM EVNENFDDPN LIILPLAFGK RQGREFIWND

601 LLSLETGSLK LANGRVIEKT LYNRRTRQDE PALFVALTFE RREVLDSSNI KPMNLIGIDR

661 GENIPAVIAL TDPEGCPLSR FKDSLGNPTH ILRIGESYKE KQRTIQAAKE VEQRRAGGYS

721 RKYASKAKNL ADDMVRNTAR DLLYYAVTQD AMLIFENLSR GFGRQGKRTF MAERQYTRME

781 DWLTAKLAYE GLPSKTYLSK TLAQYTSKTC SNCGFTITSA DYDRVLEKLK KTATGWMTTI

841 NGKELKVEGQ ITYYNRYKRQ NVVKDLSVEL DRLSEESVNN DISSWTKGRS GEALSLLKKR

901 FSHRPVQEKF VCLNCGFETH ADEQAALNIA RSWLFLRSQE YKKYQTNKTT GNTDKRAFVE

961 TWQSFYRKKL KEVWKPAV.
```

In some cases, a reference CasX protein is isolated or derived from Candidatus Sungbacteria having a sequence of

```
                                                  (SEQ ID NO: 3)
  1 MDNANKPSTK SLVNTTRISD HFGVTPGQVT RVFSFGIIPT KRQYAIIERW FAAVEAARER

 61 LYGMLYAHFQ ENPPAYLKEK FSYETFFKGR PVLNGLRDID PTIMTSAVFT ALRHKAEGAM

121 AAFHTNHRRL FEEARKKMRE YAECLKANEA LLRGAADIDW DKIVNALRTR LNTCLAPEYD

181 AVIADFGALC AFRALIAETN ALKGAYNHAL NOMLPALVKV DEPEEAEESP RLRFENGRIN

241 DLPKFPVAER ETPPDTETII RQLEDMARVI PDTAEILGYI HRIRHKAARR KPGSAVPLPQ

301 RVALYCAIRM ERNPEEDPST VAGHELGEID RVCEKRRQGL VRTPEDSQIR ARYMDIISER

361 ATLAHPDRWT EIQFLRSNAA SRRVRAETIS APFEGFSWTS NRTNPAPQYG MALAKDANAP

421 ADAPELCICL SPSSAAFSVR EKGGDLIYMR PTGGRRGKDN PGKEITWVPG SFDEYPASGV

481 ALKLRLYFGR SQARRMLINK TWGLLSDNPR VFAANAELVG KKRNPODRWK LFFHMVISGP

541 PPVEYLDESS DVRSRARTVI GINRGEVNPL AYAVVSVEDG QVLEEGLLGK KEYIDQLIET

601 RRRISEYQSR EQTPPRDLRQ RVRHLODTVL GSARAKIHSL IAFWKGILAI ERLDDQFHGR

661 EQKIIPKKTY LANKTGEMNA LSFSGAVRVD KKGNPWGGMI EIYPGGISRT CTQCGTVWLA

721 RRPKNPGHRD AMVVIPDIVD DAAATGFDNV DCDAGTVDYG ELFTLSREWV RLTPRYSRVM

781 RGTLGDLERA IRQGDDRKSR QMLELALEPQ PQWGOFFCHR CGENGQSDVL AATNLARRAI

841 SLIRRLPDTD TPPTP.
```

tutions of D672A, E769A and/or D935A with reference to SEQ ID NO: 1. In other embodiments, a catalytically-dead b. Catalytically-Dead CasX Variant Proteins In the repressor fusion proteins and systems comprising same of the disclosure, the CasX protein is catalytically-dead (dCasX) in that it is unable to cleave DNA, but retains the ability to bind a target nucleic acid when complexed with a guide RNA (gRNA). The present disclosure provides catalytically-dead variants (interchangeably referred to herein as "dCasX variant" or "dCasX variant protein"), wherein the catalytically-dead CasX variants comprise multiple modifications in select domains relative to the catalytically-dead versions of sequences of SEQ ID NOS: 1-3 (described, supra). An exemplary catalytically-dead CasX protein comprises one or more mutations in the active site of the RuvC domain of the CasX protein. In some embodiments, a catalytically-dead reference CasX protein comprises substitutions at residues 672, 769 and/or 935 with reference to SEQ ID NO: 1. In some embodiments, a catalytically-dead reference CasX protein comprises substireference CasX protein comprises substitutions at amino acids 659, 756 and/or 922 with reference to SEQ ID NO: 2. In some embodiments, a catalytically-dead reference CasX protein comprises D659A, E756A and/or D922A substitutions with reference to of SEQ ID NO: 2. An exemplary RuvC domain of the dCasX of the disclosure comprises amino acids 661-824 and 935-986 of SEQ ID NO: 1, or amino acids 648-812 and 922-978 of SEQ ID NO: 2, with one or more amino acid modifications relative to said RuvC cleavage domain sequence, wherein the dCasX variant exhibits one or more improved characteristics compared to the reference dCasX. In further embodiments, a catalytically-dead CasX variant protein comprises deletions of all or part of the RuvC domain of the reference CasX protein. It will be understood that the same foregoing substitutions or deletions can similarly be introduced into CasX variants known in the art, resulting in a dCasX variant (see, e.g., WO2022120095A1 and U.S. Pat. No. 11,560,555, incorporated by reference herein, for exemplary sequences).

In some embodiments, the dCasX variant with linked repressor domains exhibits at least one improved characteristic compared to the reference dCasX protein with linked repressor domains configured in a comparable fashion. All dCasX variants that improve one or more functions or characteristics of the dCasX variant protein with linked repressor domain compared to a reference dCasX protein with linked repressor domain described herein are envisaged as being within the scope of the disclosure. In some embodiments, the modification is a mutation in one or more amino acids of the reference dCasX other than those rendering the dCasX catalytically-dead. For example, dCasX variants can comprise one or more amino acid substitutions, insertions, deletions, or swapped domains, or any combinations thereof, relative to a reference dCasX protein sequence. Any amino acid can be substituted for any other amino acid in the substitutions described herein. The substitution can be a conservative substitution (e.g., a basic amino acid is substituted for another basic amino acid). The substitution can be a non-conservative substitution (e.g., a basic amino acid is substituted for an acidic amino acid or vice versa). For example, a proline in a reference dCasX protein can be substituted for any of arginine, histidine, lysine, aspartic acid, glutamic acid, serine, threonine, asparagine, glutamine, cysteine, glycine, alanine, isoleucine, leucine, methionine, phenylalanine, tryptophan, tyrosine or valine to generate a dCasX variant protein of the disclosure. In some embodiments, the dCasX variant exhibits an improved characteristic compared to a reference dCasX. Exemplary improved characteristics of the dCasX variant embodiments include, but are not limited to improved folding of the variant, increased binding affinity to the gRNA, increased binding affinity to the target nucleic acid, improved ability to utilize a greater spectrum of PAM sequences in the repression and/or binding of target nucleic acid, improved unwinding of the target DNA, increased target strand loading, increased binding of the non-target strand of DNA, improved protein stability, increased ability to complex with gRNA, improved protein:gRNA (RNP) complex stability, and, with linked repressor domains and when complexed as an RNP, increased repressor activity, improved repressor specificity for the target nucleic acid, decreased off-target repression, increased percentage of a eukaryotic genome that can be efficiently repressed and/or epigenetically modified. In some embodiments, an improved characteristic of the dCasX variant is at least about 1.1 to about 100,000-fold improved relative to the reference dCasX protein. In some embodiments, an improved characteristic of the dCasX variant is at least about 1.1 to about 10,000-fold improved, at least about 1.1 to about 1,000-fold improved, at least about 1.1 to about 500-fold improved, at least about 1.1 to about 400-fold improved, at least about 1.1 to about 300-fold improved, at least about 1.1 to about 200-fold improved, at least about 1.1 to about 100-fold improved, at least about 1.1 to about 50-fold improved, at least about 1.1 to about 40-fold improved, at least about 1.1 to about 30-fold improved, at least about 1.1 to about 20-fold improved, at least about 1.1 to about 10-fold improved, at least about 1.1 to about 9-fold improved, at least about 1.1 to about 8-fold improved, at least about 1.1 to about 7-fold improved, at least about 1.1 to about 6-fold improved, at least about 1.1 to about 5-fold improved, at least about 1.1 to about 4-fold improved, at least about 1.1 to about 3-fold improved, at least about 1.1 to about 2-fold improved, at least about 1.1 to about 1.5-fold improved, at least about 1.5 to about 3-fold improved, at least about 1.5 to about 4-fold improved, at least about 1.5 to about 5-fold improved, at least about 1.5 to about 10-fold improved, at least about 5 to about 10-fold improved, at least about 10 to about 20-fold improved, at least 10 to about 30-fold improved, at least 10 to about 50-fold improved or at least 10 to about 100-fold improved relative to the reference dCasX protein. In some embodiments, an improved characteristic of the dCasX variant is at least about 10 to about 1000-fold improved relative to the reference dCasX protein. Additional disclosure on improved characteristics is described herein, below.

In other embodiments, the modification is a substitution of one or more domains of the reference dCasX with one or more domains from a different CasX. In some embodiments, insertion includes the insertion of a part or all of a domain from a different CasX protein. Mutations can be placed in any one or more domains of the dCasX variant, and may include, for example, deletion of part or all of one or more domains, or one or more amino acid substitutions, deletions, or insertions in any domain. The domains of dCasX proteins include the non-target strand binding (NTSB) domain, the target strand loading (TSL) domain, the helical I domain, the helical II domain, the oligonucleotide binding domain (OBD), and the RuvC DNA cleavage domain, which can further comprise subdomains, described below.

Suitable mutagenesis methods for generating dCasX variant proteins of the disclosure may include, for example, Deep Mutational Evolution (DME), deep mutational scanning (DMS), error prone PCR, cassette mutagenesis, random mutagenesis, staggered extension PCR, gene shuffling, or domain swapping. In some embodiments, the dCasX variants are designed, for example by selecting one or more desired mutations in a reference dCasX. In certain embodiments, the activity of a reference dCasX protein is used as a benchmark against which the activity of one or more dCasX variants are compared, thereby measuring improvements in function of the dCasX variants.

In some embodiments, the dCasX variant protein comprises between 700 and 1200 amino acids, between 800 and 1100 amino acids or between 900 and 1000 amino acids.

The dCasX and linked repressor domains of the disclosure have an enhanced ability to efficiently bind target nucleic acid, when complexed with a gRNA as an RNP, utilizing and binding to a PAM TC motif, including PAM sequences selected from TTC, ATC, GTC, or CTC, compared to an RNP of a reference dCasX protein and reference gRNA in a comparable assay system. In the foregoing, the PAM sequence is located at least 1 nucleotide 5' to the non-target strand of the protospacer having identity with the targeting sequence of the gRNA.

In some embodiments, an RNP comprising the dCasX variant protein with linked repressor domains and a gRNA of the disclosure, at a concentration of 20 pM or less, is capable of binding a double stranded DNA target with an efficiency of at least 70%, at least 80%, at least 85%, at least 90% or at least 95%. In one embodiment, an RNP of a dCasX variant with linked repressor domains and a gRNA variant exhibits greater binding of a target sequence in the target nucleic acid compared to an RNP comprising a reference dCasX protein with linked repressor domains and a reference gRNA in a comparable assay system, wherein the PAM sequence of the target nucleic acid is TTC. In another embodiment, an RNP of a dCasX variant with linked repressor domains and gRNA variant exhibits greater binding affinity of a target sequence in the target nucleic acid compared to an RNP comprising a reference dCasX protein with linked repressor domains and a reference gRNA in a comparable assay system, wherein the PAM sequence of the target nucleic acid is ATC. In another embodiment, an RNP of a dCasX variant with linked repressor domains and gRNA variant exhibits greater binding affinity of a target sequence in the target nucleic acid compared to an RNP comprising a reference dCasX protein with linked repressor domains and a reference gRNA in a comparable assay system, wherein the PAM sequence of the target nucleic acid is CTC. In another embodiment, an RNP of a dCasX variant with linked repressor domains and gRNA variant exhibits greater binding affinity of a target sequence in the target nucleic acid compared to an RNP comprising a reference dCasX protein with linked repressor domains and a reference gRNA in a comparable assay system, wherein the PAM sequence of the target nucleic acid is GTC. In the foregoing embodiments, the increased binding affinity for the one or more PAM sequences is at least 1.5-fold greater or more compared to the binding affinity of an RNP of any one of the reference dCasX proteins (modified from SEQ ID NOS: 1-3) with linked repressor domains and the gRNA of SEQ ID NOS: 1731-1743 of Table 6 for the PAM sequences.

c. dCasX Variant Proteins with Domains from Multiple Source Proteins

Also contemplated within the scope of the disclosure are chimeric dCasX proteins. As used herein, a "chimeric dCasX" protein refers to both a dCasX protein containing at least two domains from different sources, as well a dCasX protein containing at least one domain that itself is chimeric. Accordingly, in some embodiments, a chimeric dCasX protein is one that includes at least two domains isolated or derived from different sources, such as from two different naturally occurring CasX proteins, (e.g., from two different CasX reference proteins), or from two different engineered CasX proteins. In some embodiments, the helical I-I domain and NTSB domain of the dCasX variant derived from SEQ ID NO: 2 is replaced with the corresponding helical I-I and NTSB sequences from SEQ ID NO: 1, resulting in a chimeric dCasX protein. As another example of the foregoing, the chimeric RuvC domain comprises amino acids 660 to 823 of SEQ ID NO: 1 and amino acids 921 to 978 of SEQ ID NO: 2. As an alternative example of the foregoing, a chimeric RuvC domain comprises amino acids 647 to 810 of SEQ ID NO: 2 and amino acids 934 to 986 of SEQ ID NO: 1.

In other embodiments, the chimeric dCasX protein is one that contains at least one domain that is a chimeric domain, e.g., in some embodiments, part of a domain comprises a substitution from a different CasX protein (from a reference CasX protein, or another engineered CasX protein). In some embodiments, the at least one chimeric domain can be any of the NTSB, TSL, helical I, helical II, OBD or RuvC domains as described herein. In some embodiments, the helical I-I domain (sometimes referred to as helical I-a) of the dCasX variant derived from SEQ ID NO: 2 is replaced with the corresponding helical I-I sequence from SEQ ID NO: 1, resulting in a chimeric dCasX protein.

Sequences of Table 2 having the NTSB domain and helical I-II domain from SEQ ID NO: 1 and a helical I-I domain from SEQ ID NO: 2 include dCasX 491, 515, 516, 518-520, 522-527, 532, 593, 676 (with a L169K substitution in the NTSB domain), and 812 (see Table 2 for SEQ ID NOS). Coordinates of CasX domains in the reference CasX proteins of SEQ ID NO: 1 and SEQ ID NO: 2 are provided in Table 1 below. The skilled artisan will understand that the domain boundaries indicated in Table 1 below are approximate, and that protein fragments whose boundaries differ from those given in the table below by 1, 2, or 3 amino acids may have the same activity as the domains described below. In some embodiments, the disclosure provides the CasX proteins of SEQ ID NOS: 3281-3441, or 3444-3446 having the NTSB domain and helical I-II domain from SEQ ID NO: 1 and a helical I-I domain from SEQ ID NO: 2, wherein the CasX have additional amino acid changes (i.e., 1, 2, 3, 4, or 5 mismatches) at select locations relative to the domains of the reference CasX, and that are rendered catalytically dead by introducing one or more mutations that inactivates the cleavage activity of the RuvC domain.

TABLE 1

Domain coordinates in Reference CasX proteins

| Domain Name | Coordinates in SEQ ID NO: 1* | Coordinates in SEQ ID NO: 2* |
|---|---|---|
| OBD-I | 1-55 | 1-57 |
| helical I-I | 56-99 | 58-101 |
| NTSB | 100-190 | 102-191 |
| helical I-II | 191-331 | 192-332 |
| helical II | 332-508 | 333-500 |
| OBD-II | 509-659 | 501-646 |
| RuvC-I | 660-823 | 647-810 |
| TSL | 824-933 | 811-920 |
| RuvC-II | 934-986 | 921-978 |

*amino acid position

In some embodiments, a dCasX variant protein utilized in the fusion proteins of the disclosure comprises a sequence of SEQ ID NOS: 4-29 as set forth in Table 2. In other embodiments, a dCasX variant protein utilized in the fusion proteins of the disclosure comprises a sequence at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical to a sequence of SEQ ID NOS: 4-29 as set forth in Table 2. In a particular embodiment, the dCasX variant protein utilized in the fusion protein of the gene repressor systems of the disclosure comprises a sequence of SEQ ID NO: 4 (dCasX 491). In another particular embodiment, the dCasX variant protein utilized in the fusion protein of the gene repressor systems of the disclosure comprises a sequence of SEQ ID NO: 6 (dCasX 515). In another particular embodiment, the dCasX variant protein utilized in the fusion protein of the gene repressor systems of the disclosure comprises a sequence of SEQ ID NO: 29 (dCasX 812).

TABLE 2 dCasX Variant Sequences

| SEQ ID NO | dCasX | Amino Acid Sequence |
|---|---|---|
| 4 | dCasX491 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLSKTYLSKTLAQYTSKTCSNCGFTITSADYDRVLE<br>KLKKTATGWMTTINGKELKVEGQITYYNRYKRQNVVKDLSVELDRLSEESVNNDISSWT<br>KGRSGEALSLLKKRFSHRPVQEKFVCLNCGFETHAAEQAALNIARSWLFLRSQEYKKYQ<br>TNKTTGNTDKRAFVETWQSFYRKKLKEVWKPAV |
| 5 | dCasX514 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLSKTYLSKTLAQYTSKTCSNCGFTIHTSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |
| 6 | dCasX515 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>7KDEFCRCELKLQKWYGDLRGKPFAIEAENSILDISGFSKQYNCAFIWQKDGVKKLNLY<br>LIINYFKGGKLRFKKIKPEAFEANRFYTVINKKSGEIVPMEVNENFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTEMAERQYTRMEDWLTAKLAYEGLPSKTYLSKTLAQYTSKTCSNCGFTITSADYDRV<br>LEKLKKTATGWMTTINGKELKVEGQITYYNRYKRQNVVKDLSVELDRLSEESVNNDISS<br>WTKGRSGEALSLLKKRFSHRPVQEKFVCLNCGFETHAAEQAALNIARSWLELRSQEYKK<br>YQTNKTTGNTDKRAFVETWQSFYRKKLKEVWKPAV |
| 7 | dCasX516 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNHNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNFNFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLSKTYLSKTLAQYTSKTCSNCGFTITSADYDRVLE<br>KLKKTATGWMTTINGKELKVEGQITYYNRYKRQNVVKDLSVELDRLSEESVNNDISSWT<br>KGRSGEALSLLKKRFSHRPVQEKFVCLNCGFETHAAEQAALNIARSWLFLRSQEYKKYQ<br>TNKTTGNTDKRAFVETWQSFYRKKLKEVWKPAV |

TABLE 2-continued dCasX Variant Sequences

| SEQ ID NO | dCasX | Amino Acid Sequence |
|---|---|---|
| 8 | dCasX517 | QEIKRINKIRRRLVKDSNTKKAGKTGPMKTLLVRVMTPDLRERLENLRKKPENIPQPIS NTSRANLNKLLTDYTEMKKAILHVYWEEFQKDPVGLMSRVAQPASKKIDQNKLKPEMDE KGNLTTAGFACSQCGQPLFVYKLEQVSEKGKAYTNYFGRCNVAEHEKLILLAQLKPEKD SDEAVTYSLGKFGQRALDFYSIHVTKESTHPVKPLAQIAGNRYASGAPVGKALSDACMG TIASFLSKYQDIIIEHQKVVKGNQKRLESLRELAGKENLEYPSVTLPPQPHTKEGVDAY NEVIARVRMWVNLNLWQKLKLSRDDAKPLLRLKGFPSFPLVERQANEVDWWDMVCNVKK LINEKKEDGKVFWQNLAGYKRQEALRPYLSSEEDRKKGKKFARYQLGDLLLHLEKKHGE DWGKVYDEAWERIDKKVEGLSKHIKLEEERRSEDAQSKAALTDWLRAKASFVIEGLKEA DKDEFCRCELKLQKWYGDLRGKPFAIEAENSILDISGFSKQYNCAFIWQKDGVKKLNLY LIINYFKGGKLRFKKIKPEAFEANRFYTVINKKSGEIVPMEVNENFDDPNLIILPLAFG KRQGREFIWNDLLSLETGSLKLANGRVIEKTLYNRRTRQDEPALFVALTFERREVLDSS NIKPMNLIGVARGENIPAVIALTDPEGCPLSRFKDSLGNPTHILRIGESYKEKQRTIQA KKEVEQRRAGGYSRKYASKAKNLADDMVRNTARDLLYYAVTQDAMLIFANLSRGFGRQG KRTEMAERQYTRMEDWLTAKLAYEGLSKTYLSKTLAQYTSKTCSNCGFTITSADYDRVL EKLKKTATGWMTTINGKELKVEGQITYYNRYKRQNVVKDLSVELDRLSEESVNNDISSW TKGRSGEALSLLKKRFSHRPVQEKFVCLNCGFETHAAEQAALNIARSWLFLRSQEYKKY QTNKTTGNTDKRAFVETWQSFYRKKLKEVWKPAV |
| 9 | dCasX518 | RQEIKRINKIRRRLVKDSNTKKAGKTGPMKTLLVRVMTPDLRERLENLRKKPENIPQPI SNTSRANLNKLLTDYTEMKKAILHVYWEEFQKDPVGLMSRVAQPASKKIDQNKLKPEMD EKGNLTTAGFACSQCGQPLFVYKLEQVSEKGKAYTNYFGRCNVAEHEKLILLAQLKPEK DSDEAVTYSLGKFGQRALDFYSIHVTKESTHPVKPLAQIAGNRYASGPVGKALSDACMG TIASFLSKYQDIIIEHQKVVKGNQKRLESLRELAGKENLEYPSVTLPPQPHTKEGVDAY NEVIARVRMWVNLNLWQKLKLSRDDAKPLLRLKGFPSFPLVERQANEVDWWDMVCNVKK LINEKKEDGKVFWQNLAGYKRQEALRPYLSSEEDRKKGKKFARYQLGDLLLHLEKKHGE DWGKVYDEAWERIDKKVEGLSKHIKLEEERRSEDAQSKAALTDWLRAKASFVIEGLKEA DKDEFCRCELKLQKWYGDLRGKPFAIEAENSILDISGFSKQYNCAFIWQKDGVKKLNLY LIINYFKGGKLRFKKIKPEAFEANRFYTVINKKSGEIVPMEVNENFDDPNLIILPLAFG KRQGREFIWNDLLSLETGSLKLANGRVIEKTLYNRRTRQDEPALFVALTFERREVLDSS NIKPMNLIGVARGENIPAVIALTDPEGCPLSRFKDSLGNPTHILRIGESYKEKQRTIQA KKEVEQRRAGGYSRKYASKAKNLADDMVRNTARDLLYYAVTQDAMLIFANLSRGFGRQG KRTEMAERQYTRMEDWLTAKLAYEGLSKTYLSKTLAQYTSKTCSNCGFTITSADYDRVL EKLKKTATGWMTTINGKELKVEGQITYYNRYKRQNVVKDLSVELDRLSEESVNNDISSW TKGRSGEALSLLKKRFSHRPVQEKFVCLNCGFETHAAEQAALNIARSWLFLRSQEYKKY QTNKTTGNTDKRAFVETWQSFYRKKLKEVWKPAV |
| 10 | dCasX519 | QEIKRINKIRRRLVKDSNTKKAGKTGPMKTLLVRVMTPDLRERLENLRKKPENIPQPIS NTSRANLNKLLTDYTEMKKAILHVYWEEFQKDPVGLMSRVAQPASKKIDQNKLKPEMDE KGNLTTAGFACSQCGQPLFVYKLEQVSEKGKAYTNYFGRCNVAEHEKLILLAQLKPEKD SDEAVTYSLGKFGQRALDFYSIHVTKESTHPVKPLAQIAGNRYASGPVGKALSDACMGT IASFLSKYQDIIIEHQKVVKGNQKRLESLRELAGKENLEYPSVTLPPQPHTKEGVDAYN EVIARVRMWVNLNLWQKLKLSRDDAKPLLRLKGFPSFPLVERQANEVDWWDMVCNVKKL INEKKEDGKVFWQNLAGYKRQEALRPYLSSEEDRKKGKKFARYQLGDLLLHLEKKHGED WGKVYDEAWERIDKKVEGLSKHIKLEEERRSEDAQSKAALTDWLRAKASFVIEGLKEAD KDEFCRCELKLQKWYGDLRGKPFAIEAENSILDISGFSKQYNCAFIWQKDGVKKLNLYL IINYFKGGKLRFKKIKPEAFEANRFYTVINKKSGEIVPMEVNENFDDPNLIILPLAFGK RQGREFIWNDLLSLETGSLKLANGRVIEKTLYNRRTRQDEPALFVALTFERREVLDSSN IKPMNLIGVARGENIPAVIALTDPEGCPLSRFKDSLGNPTHIQLRIGESYKEKQRTIQA KKEVEQRRAGGYSRKYASKAKNLADDMVRNTARDLLYYAVTQDAMLIFANLSRGFGRQG KRTFMAERQYTRMEDWLTAKLAYEGLSKTYLSKTLAQYTSKTCSNCGFTITSADYDRVL EKLKKTATGWMTTINGKELKVEGQITYYNRYKRQNVVKDLSVELDRLSEESVNNDISSW TKGRSGEALSLLKKRFSHRPVQEKFVCLNCGFETHAAEQAALNIARSWLFLRSQEYKKY QTNKTTGNTDKRAFVETWQSFYRKKLKEVWKPAV |
| 11 | dCasX520 | QEIKRINKIRRRLVKDSNTKKAGKTGPMKTLLVRVMTPDLRERLENLRKKPENIPQPIS NTSRANLNKLLTDYTEMKKAILHVYWEEFQKDPVGLMSRVAQPASKKIDQNKLKPEMDE KGNLTTAGFACSQCGQPLFVYKLEQVSEKGKAYTNYFGRCNVAEHEKLILLAQLKPEKD SDEAVTYSLGKFGQRALDFYSIHVTKESTHPVKPLAQIAGNRYASGPVGKALSDACMGT IASFLSKYQDIIIEHQKVVKGNQKRLESLRELAGKENLEYPSVTLPPQPHTKEGVDAYN EVIARVRMWVNLNLWQKLKLSRDDAKPLLRLKGFPSFPLVERQANEVDWWDMVCNVKKL INEKKEDGKVFWQNLAGYKRQEALRPYLSSEEDRKKGKKFARYQLGDLLLHLEKKHGED WGKVYDEAWERIDKKVEGLSKHIKLEEERRSEDAQSKAALTDWLRAKASFVIEGLKEAD KDEFCRCELKLQKWYGDLRGKPFAIEAENSILDISGFSKQYNCAFIWQKDGVKKLNLYL IINYFKGGKLRFKKIKPEAFEANRFYTVINKKSGEIVPMEVNENFDDPNLIILPLAFGK RQGREFIWNDLLSLETGSLKLANGRVIEKTLYNRRTRQDEPALFVALTFERREVLDSSN IKPMNLIGVARGENIPAVIALTDPEGCPLSRFKDSLGNPTHILRIGESYKEKQRTTQAK KEVEQRRAGGYSRKYASKAKNLADDMVRNTARDLLYYAVTQDAMLIFANLSRGFGRQGK RTFMAERQYTRMEDWLTAKLAYEGLSKTYLSKTLAQYTSKTCSNCGFTITSADYDRVLE KLKKTATGWMTTINGKELKVEGQITYYNRYKRQNVVKDLSVELDRLSEESVNNDISSWT KGRSGEALSLLKKRFSHRPVQEKFVCLNCGFETHAAEQAALNIARSWLFLRSQEYKKYQ TNKTTGNTDKRAFVETWQSFYRKKLKEVWKPAV |

TABLE 2-continued dCasX Variant Sequences

| SEQ ID NO | dCasX | Amino Acid Sequence |
|---|---|---|
| 12 | dCasX522 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKRSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLSKTYLSKTLAQYTSKTCSNCGFTITSADYDRVLE<br>KLKKTATGWMTTINGKELKVEGQITYYNRYKRQNVVKDLSVELDRLSEESVNNDISSWT<br>KGRSGEALSLLKKRFSHRPVQEKFVCLNCGFETHAAEQAALNIARSWLFLRSQEYKKYQ<br>TNKTTGNTDKRAFVETWQSFYRKKLKEVWKPAV |
| 13 | dCasX523 | QEIKRINKIRRRLVKDSNTKKAGKTYPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNFNFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLSKTYLSKTLAQYTSKTCSNCGFTITSADYDRVLE<br>KLKKTATGWMTTINGKELKVEGQITYYNRYKRQNVVKDLSVELDRLSEESVNNDISSWT<br>KGRSGEALSLLKKRFSHRPVQEKFVCLNCGFETHAAEQAALNIARSWLFLRSQEYKKYQ<br>TNKTTGNTDKRAFVETWQSFYRKKLKEVWKPAV |
| 14 | dCasX524 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLSKTYLSKTLAQYTSKTCSNCGFTIHSADYDRVLE<br>KLKKTATGWMTTINGKELKVEGQITYYNRYKRQNVVKDLSVELDRLSEESVNNDISSWT<br>KGRSGEALSLLKKRFSHRPVQEKFVCLNCGFETHAAEQAALNIARSWLFLRSQEYKKYQ<br>TNKTTGNTDKRAFVETWQSFYRKKLKEVWKPAV |
| 15 | dCasX525 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAATQDAMLIFANLSRGFGRQGK<br>RTFMAERQYTRMEDWLTAKLAYEGLSKTYLSKTLAQYTSKTCSNCGFTITSADYDRVLE<br>KLKKTATGWMTTINGKELKVEGQITYYNRYKRQNVVKDLSVELDRLSEESVNNDISSWT<br>KGRSGEALSLLKKRFSHRPVQEKFVCLNCGFETHAAEQAALNIARSWLFLRSQEYKKYQ<br>TNKTTGNTDKRAFVETWQSFYRKKLKEVWKPAV |

TABLE 2-continued dCasX Variant Sequences

| SEQ ID NO | dCasX | Amino Acid Sequence |
|---|---|---|
| 16 | dCasX526 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAA<br>KEVEQRRAGGYSRKYASKAKNLADDMVRNTARDLLYYAVTQDAMLIFANLSRGFGRQGK<br>RTFMAERQYTRMEDWLTAKLAYEGLSKTYLSKTLAQYTSKTCSNCGFTITSADYDRVLE<br>KLKKTATGWMTTINGKELKVEGQITYYNRYKRQNVVKDLSVELDRLSEESVNNDISSWT<br>KGRSGEALSLLKKRFSHRPVQEKFVCLNCGFETHAAEQAALNIARSWLFLRSQEYKKYQ<br>TNKTTGNTDKRAFVETWQSFYRKKLKEVWKPAV |
| 17 | dCasX527 | QEIKRINKIRRRLVKDSNTKKAGKTRGPMKTLLVRVMTPDLRERLENLRKKPENIPQPI<br>SNTSRANLNKLLTDYTEMKKAILHVYWEEFQKDPVGLMSRVAQPASKKIDQNKLKPEMD<br>EKGNLTTAGFACSQCGQPLFVYKLEQVSEKGKAYTNYFGRCNVAEHEKLILLAQLKPEK<br>DSDEAVTYSLGKFGQRALDFYSIHVTKESTHPVKPLAQIAGNRYASGPVGKALSDACMG<br>TIASFLSKYQDIIIEHQKVVKGNQKRLESLRELAGKENLEYPSVTLPPQPHTKEGVDAY<br>NEVIARVRMWVNLNLWQKLKLSRDDAKPLLRLKGFPSFPLVERQANEVDWWDMVCNVKK<br>LINEKKEDGKVFWQNLAGYKRQEALRPYLSSEEDRKKGKKFARYQLGDLLLHLEKKHGE<br>DWGKVYDEAWERIDKKVEGLSKHIKLEEERRSEDAQSKAALTDWLRAKASFVIEGLKEA<br>DKDEFCRCELKLQKWYGDLRGKPFAIEAENSILDISGFSKQYNCAFIWQKDGVKKLNLY<br>LIINYFKGGKLRFKKIKPEAFEANRFYTVINKKSGEIVPMEVNENFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTEMAERQYTRMEDWLTAKLAYEGLSKTYLSKTLAQYTSKTCSNCGFTITSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |
| 18 | dCasX528 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASYPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLPSKTYLSKTLAQYTSKTCSNCGFTITSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |
| 19 | dCasX529 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASNPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNFNFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLPSKTYLSKTLAQYTSKTCSNCGFTITSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |

TABLE 2-continued dCasX Variant Sequences

| SEQ ID NO | dCasX | Amino Acid Sequence |
|---|---|---|
| 20 | dCasX530 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGWGKLRFKKIKPEAFEANRFYTVINKKSGEIVPMEVNFNFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTFMAERQYTRMEDWLTAKLAYEGLPSKTYLSKTLAQYTSKTCSNCGFTITSADYDRV<br>LEKLKKTATGWMTTINGKELKVEGQITYYNRYKRQNVVKDLSVELDRLSEESVNNDISS<br>WTKGRSGEALSLLKKRFSHRPVQEKFVCLNCGFETHAAEQAALNIARSWLFLRSQEYKK<br>YQTNKTTGNTDKRAFVETWQSFYRKKLKEVWKPAV |
| 21 | dCasX531 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGYGKLRFKKIKPEAFEANRFYTVINKKSGEIVPMEVNENFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTEMAERQYTRMEDWLTAKLAYEGLPSKTYLSKTLAQYTSKTCSNCGFTITSADYDRV<br>LEKLKKTATGWMTTINGKELKVEGQITYYNRYKRQNVVKDLSVELDRLSEESVNNDISS<br>WTKGRSGEALSLLKKRFSHRPVQEKFVCLNCGFETHAAEQAALNIARSWLFLRSQEYKK<br>YQTNKTTGNTDKRAFVETWQSFYRKKLKEVWKPAV |
| 22 | dCasX532 | QEIKRINKIRRRLVKDSNTKKAGKTRGPMKTLLVRVMTPDLRERLENLRKKPENIPQPI<br>SNTSRANLNKLLTDYTEMKKAILHVYWEEFQKDPVGLMSRVAQPASKKIDQNKLKPEMD<br>EKGNLTTAGFACSQCGQPLFVYKLEQVSEKGKAYTNYFGRCNVAEHEKLILLAQLKPEK<br>DSDEAVTYSLGKFGQRALDFYSIHVTKESTHPVKPLAQIAGNRYASGPVGKALSDACMG<br>TIASFLSKYQDIIIEHQKVVKGNQKRLESLRELAGKENLEYPSVTLPPQPHTKEGVDAY<br>NEVIARVRMWVNLNLWQKLKLSRDDAKPLLRLKGFPSFPLVERQANEVDWWDMVCNVKK<br>LINEKKEDGKVFWQNLAGYKRQEALRPYLSSEEDRKKGKKFARYQLGDLLLHLEKKHGE<br>DWGKVYDEAWERIDKKVEGLSKHIKLEEERRSEDAQSKAALTDWLRAKASFVIEGLKEA<br>DKDEFCRCELKLQKWYGDLRGKPFAIEAENSILDISGFSKQYNCAFIWQKDGVKKLNLY<br>LIINYFKGGKLRFKKIKPEAFEANRFYTVINKKSGEIVPMEVNENFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTEMAERQYTRMEDWLTAKLAYEGLPSKTYLSKTLAQYTSKTCSNCGFTITSADYDRV<br>LEKLKKTATGWMTTINGKELKVEGQITYYNRYKRQNVVKDLSVELDRLSEESVNNDISS<br>WTKGRSGEALSLLKKRFSHRPVQEKFVCLNCGFETHAAEQAALNIARSWLFLRSQEYKK<br>YQTNKTTGNTDKRAFVETWQSFYRKKLKEVWKPAV |
| 23 | dCasX533 | QEIKRINKIRRRLVKDSNTKKAGKTRGPMKTLLVRVMTPDLRERLENLRKKPENIPQPI<br>SNTSRANLNKLLTDYTEMKKAILHVYWEEFQKDPVGLMSRVAQPASKKIDQNKLKPEMD<br>EKGNLTTAGFACSQCGQPLFVYKLEQVSEKGKAYTNYFGRCNVAEHEKLILLAQLKPEK<br>DSDEAVTYSLGKFGQRALDFYSIHVTKESTHPVKPLAQIAGNRYASYPVGKALSDACMG<br>TIASFLSKYQDIIIEHQKVVKGNQKRLESLRELAGKENLEYPSVTLPPQPHTKEGVDAY<br>NEVIARVRMWVNLNLWQKLKLSRDDAKPLLRLKGFPSFPLVERQANEVDWWDMVCNVKK<br>LINEKKEDGKVFWQNLAGYKRQEALRPYLSSEEDRKKGKKFARYQLGDLLLHLEKKHGE<br>DWGKVYDEAWERIDKKVEGLSKHIKLEEERRSEDAQSKAALTDWLRAKASFVIEGLKEA<br>DKDEFCRCELKLQKWYGDLRGKPFAIEAENSILDISGFSKQYNCAFIWQKDGVKKLNLY<br>LIINYFKGGKLRFKKIKPEAFEANRFYTVINKKSGEIVPMEVNENFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTEMAERQYTRMEDWLTAKLAYEGLPSKTYLSKTLAQYTSKTCSNCGFTITSADYDRV<br>LEKLKKTATGWMTTINGKELKVEGQITYYNRYKRQNVVKDLSVELDRLSEESVNNDISS<br>WTKGRSGEALSLLKKRFSHRPVQEKFVCLNCGFETHAAEQAALNIARSWLFLRSQEYKK<br>YQTNKTTGNTDKRAFVETWQSFYRKKLKEVWKPAV |

TABLE 2-continued dCasX Variant Sequences

| SEQ ID NO | dCasX | Amino Acid Sequence |
|---|---|---|
| 24 | dCasX535 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASSPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLPSKTYLSKTLAQYTSKTCSNCGFTITSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |
| 25 | dCasX593 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRWWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLPSKTYLSKTLAQYTSKTCSNCGFTITSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |
| 26 | dCasX668 | QEIKRINKIRRRLVKDSNTKKAGKTRGPMKTLLVRVMTPDLRERLENLRKKPENIPQPI<br>SNTSRANLNKLLTDYTEMKKAILHVYWEEFQKDPVGLMSRVAQPASKKIDQNKLKPEMD<br>EKGNLTTAGFACSQCGQPLFVYKLEQVSEKGKAYTNYFGRCNVAEHEKLILLAQLKPEK<br>DSDEAVTYSLGKFGQRALDFYSIHVTKESTHPVKPLAQIAGNRYASSPVGKALSDACMG<br>TIASFLSKYQDIIIEHQKVVKGNQKRLESLRELAGKENLEYPSVTLPPQPHTKEGVDAY<br>NEVIARVRMWVNLNLWQKLKLSRDDAKPLLRLKGFPSFPLVERQANEVDWWDMVCNVKK<br>LINEKKEDGKVFWQNLAGYKRQEALRPYLSSEEDRKKGKKFARYQLGDLLLHLEKKHGE<br>DWGKVYDEAWERIDKKVEGLSKHIKLEEERRSEDAQSKAALTDWLRAKASFVIEGLKEA<br>DKDEFCRCELKLQKWYGDLRGKPFAIEAENSILDISGFSKQYNCAFIWQKDGVKKLNLY<br>LIINYFKGGKLRFKKIKPEAFEANRFYTVINKKSGEIVPMEVNENFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTEMAERQYTRMEDWLTAKLAYEGLPSKTYLSKTLAQYTSKTCSNCGFTITSADYDRV<br>LEKLKKTATGWMTTINGKELKVEGQITYYNRYKRQNVVKDLSVELDRLSEESVNNDISS<br>WTKGRSGEALSLLKKRFSHRPVQEKFVCLNCGFETHAAEQAALNIARSWLFLRSQEYKK<br>YQTNKTTGNTDKRAFVETWQSFYRKKLKEVWKPAV |
| 27 | dCasX672 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLIKLAQLKPEKD<br>SDEAVTYSLGKFGQRALDFYSIHVTKESTHPVKPLAQIAGNRYASSPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLPSKTYLSKTLAQYTSKTCSNCGFTITSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |

TABLE 2-continued

| dCasX Variant Sequences | | |
|---|---|---|
| SEQ ID NO | dCasX | Amino Acid Sequence |
| 28 | dCasX676 | QEIKRINKIRRRLVKDSNTKKAGKTRGPMKTLLVRVMTPDLRERLENLRKKPENIPQPI<br>SNTSRANLNKLLTDYTEMKKAILHVYWEEFQKDPVGLMSRVAQPASKKIDQNKLKPEMD<br>EKGNLTTAGFACSQCGQPLFVYKLEQVSEKGKAYTNYFGRCNVAEHEKLIKLAQLKPEK<br>DSDEAVTYSLGKFGQRALDFYSIHVTKESTHPVKPLAQIAGNRYASSPVGKALSDACMG<br>TIASFLSKYQDIIIEHQKVVKGNQKRLESLRELAGKENLEYPSVTLPPQPHTKEGVDAY<br>NEVIARVRMWVNLNLWQKLKLSRDDAKPLLRLKGFPSFPLVERQANEVDWWDMVCNVKK<br>LINEKKEDGKVFWQNLAGYKRQEALRPYLSSEEDRKKGKKFARYQLGDLLLHLEKKHGE<br>DWGKVYDEAWERIDKKVEGLSKHIKLEEERRSEDAQSKAALTDWLRAKASFVIEGLKEA<br>DKDEFCRCELKLQKWYGDLRGKPFAIEAENSILDISGFSKQYNCAFIWQKDGVKKLNLY<br>LIINYFKGGKLRFKKIKPEAFEANRFYTVINKKSGEIVPMEVNENFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTEMAERQYTRMEDWLTAKLAYEGLPSKTYLSKTLAQYTSKTCSNCGFTITSADYDRV<br>LEKLKKTATGWMTTINGKELKVEGQITYYNRYKRQNVVKDLSVELDRLSEESVNNDISS<br>WTKGRSGEALSLLKKRFSHRPVQEKFVCLNCGFETHAAEQAALNIARSWLFLRSQEYKK<br>YQTNKTTGNTDKRAFVETWQSFYRKKLKEVWKPAV |
| 29 | dCasX812 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKKFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLPSKTYLSKTLAQYTSKTCSNCGFTITSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |

In some embodiments, a dCasX comprises a sequence selected from the group consisting of SEQ ID NOS: 4-29, or a sequence having or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto. In some embodiments, a dCasX comprises a sequence selected from the group consisting of SEQ ID NOS: 4-29. In some embodiments, a dCasX comprises a sequence selected from the group consisting of SEQ ID NOS: 3281-3441 and 3444-3446, or a sequence having at least about 70%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity thereto, wherein the sequence further comprises one or mutations in the RuvC domain that render the dCasX capable of binding DNA, but is otherwise catalytically dead. In some embodiments, the one or more mutations are in the RuvC domain and render the RuvC catalytically inactive (i.e. not capable of cleaving DNA). In some embodiments, the one or more mutations comprise D659A, E756A and/or D922A substitutions corresponding to a sequence of SEQ ID NO: 2. The repressor fusion protein comprising the dCasX retains the ability to form an RNP with a gRNA. In some embodiments, the repressor fusion protein comprising the dCasX retains one or more functions of a CasX protein, including but not limited to, affinity for the gRNA, binding to the target nucleic acid, specificity for the target nucleic acid, unwinding of the target nucleic acid, target strand loading, or any combination thereof.

d. Affinity for the gRNA

In some embodiments, a dCasX with linked repressor domains has improved affinity for the gRNA relative to a reference dCasX protein, leading to the formation of the ribonucleoprotein complex. Increased affinity of the repressor fusion protein for the gRNA may, for example, result in a lower $K_d$ for the generation of a RNP complex, which can, in some cases, result in a more stable ribonucleoprotein complex formation. In some embodiments, the $K_d$ of a repressor fusion protein for a gRNA is increased relative to a reference dCasX protein and linked repressor domains by a factor of at least about 1.1, at least about 1.2, at least about 1.3, at least about 1.4, at least about 1.5, at least about 1.6, at least about 1.7, at least about 1.8, at least about 1.9, at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, or at least about 100. In some embodiments, the dCasX variant has about 1.1 to about 10-fold increased binding affinity to the gRNA compared to the catalytically-dead variant of reference CasX protein of SEQ ID NO: 2.

In some embodiments, increased affinity of the dCasX with linked repressor domains for the gRNA results in increased stability of the ribonucleoprotein complex when delivered to mammalian cells, including in vivo delivery to a subject. This increased stability can affect the function and utility of the complex in the cells of a subject, as well as result in improved pharmacokinetic properties in blood, when delivered to a subject. In some embodiments, increased affinity of the repressor fusion protein, and the resulting increased stability of the ribonucleoprotein complex, allows for a lower dose of the repressor fusion protein to be delivered to the subject or cells while still having the desired activity; for example in vivo or in vitro gene repression and/or epigenetic modification. The increased ability to form RNP and keep them in stable form can be assessed using in vitro assays known in the art.

In some embodiments, a higher affinity (tighter binding) of a dCasX variant protein and linked repressor domain to a gRNA allows for a greater amount of repression and/or epigenetic modification events when both the dCasX variant protein and the gRNA remain in an RNP complex. Increased repression events can be assessed using assays described herein.

Methods of measuring repressor fusion protein binding affinity for a gRNA include in vitro methods using purified an repressor fusion protein and a gRNA. The binding affinity for the repressor fusion protein can be measured by fluorescence polarization if the gRNA or the repressor fusion protein is tagged with a fluorophore. Alternatively, or in addition, binding affinity can be measured by biolayer interferometry, electrophoretic mobility shift assays (EMSAs), or filter binding. Additional standard techniques to quantify absolute affinities of RNA binding proteins such as the reference dCasX and variant proteins of the disclosure for specific gRNAs such as reference gRNAs and variants thereof include, but are not limited to, isothermal calorimetry (ITC), and surface plasmon resonance (SPR).

e. Improved Specificity for a Target Nucleic Acid Sequence

In some embodiments, a repressor fusion protein comprising a dCasX variant protein with linked repressor domains has improved specificity for a target nucleic acid sequence that is complementary to the targeting sequence of the gRNA relative to a reference dCasX protein with linked repressor domains. As used herein, "specificity," sometimes referred to as "target specificity," refers to the degree to which a CRISPR/Cas system ribonucleoprotein complex binds off-target sequences that are similar, but not identical to the target nucleic acid sequence; e.g., a repressor fusion protein RNP with a higher degree of specificity would exhibit reduced off-target methylation of sequences relative to an RNP of a reference dCasX with linked repressor domains. The specificity, and the reduction of potentially deleterious off-target effects, of repressor fusion proteins can be vitally important in order to achieve an acceptable therapeutic index for use in mammalian subjects.

Without wishing to be bound by theory, it is possible that amino acid changes in the helical I and II domains that increase the specificity of the repressor fusion protein for the target nucleic acid strand can increase the specificity of the repressor fusion protein for the target nucleic acid overall. In some embodiments, amino acid changes that increase specificity of repressor fusion proteins for target nucleic acid may also result in decreased affinity of repressor fusion proteins for DNA, but the overall benefit and safety of the composition is enhanced.

f. Repressor Fusion Proteins with Additional Heterologous Proteins

Also contemplated within the scope of the disclosure are repressor fusion proteins comprising one or more heterologous proteins fused to the repressor fusion protein. This includes repressor fusion proteins comprising N-terminal or C-terminal fusions to a heterologous protein or domain thereof. In some embodiments, the repressor fusion protein is fused to one or more proteins or domains thereof that has a different activity of interest.

In some cases, a heterologous polypeptide (a fusion partner) for use with a repressor fusion protein provides for subcellular localization, i.e., the heterologous polypeptide contains a subcellular localization sequence (e.g., a nuclear localization signal (NLS) for targeting to the nucleus, a sequence to keep the fusion protein out of the nucleus, a nuclear export sequence (NES), a sequence to keep the fusion protein retained in the cytoplasm, a mitochondrial localization signal for targeting to the mitochondria, a chloroplast localization signal for targeting to a chloroplast, an ER retention signal, and the like).

Figure 1:
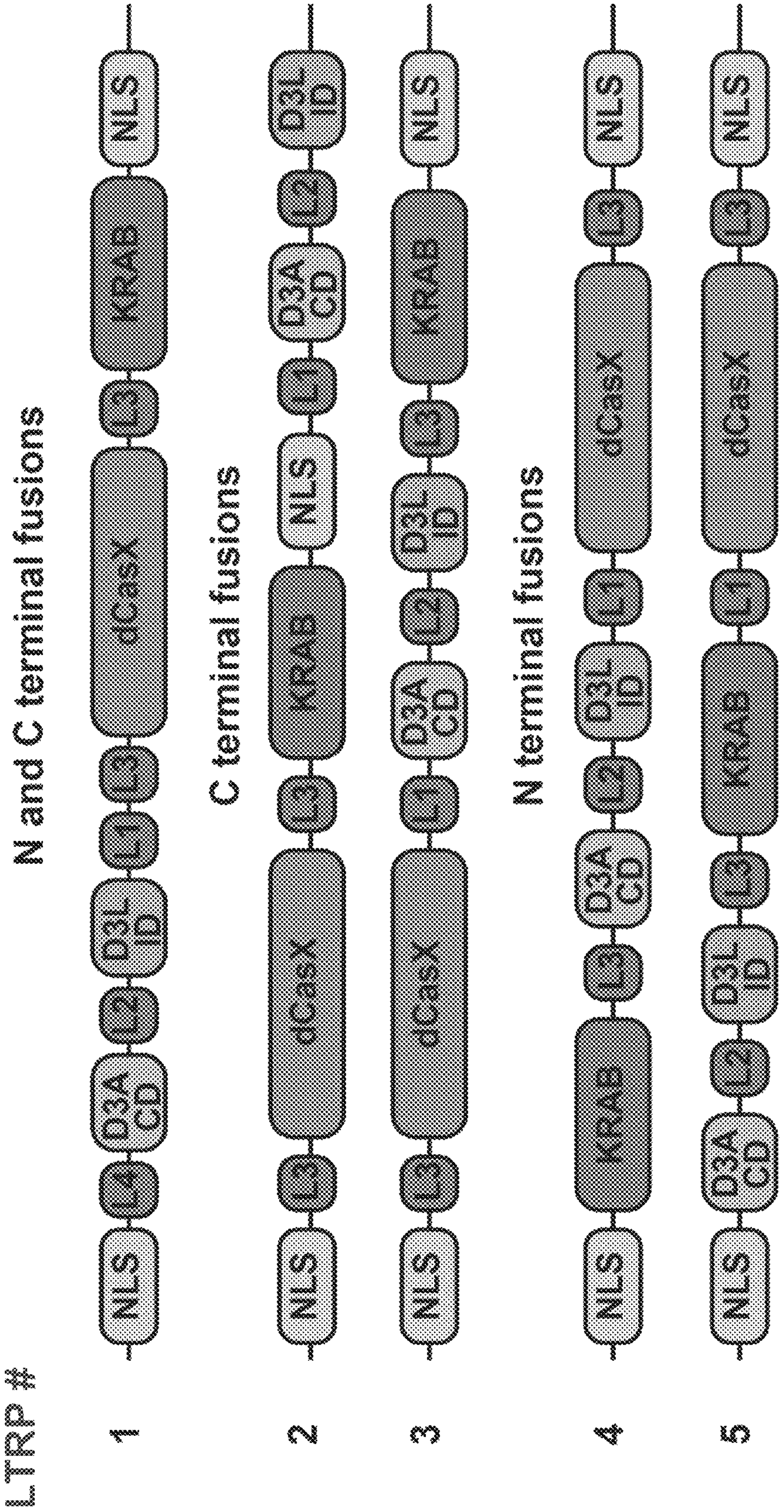
FIG. 1 illustrates the schematics of five configurations of long-term repressor protein (LTRP, also referred to herein as "repressor fusion proteins") fusion proteins with repressor molecules linked to catalytically-dead CasX. D3A and D3L denote DNA methyltransferase 3 alpha (DNMT3A) and DNMT3A-like protein (DNMT3L), respectively. L1-L4 are linkers. NLS is the nuclear localization signal.
Figure 2:
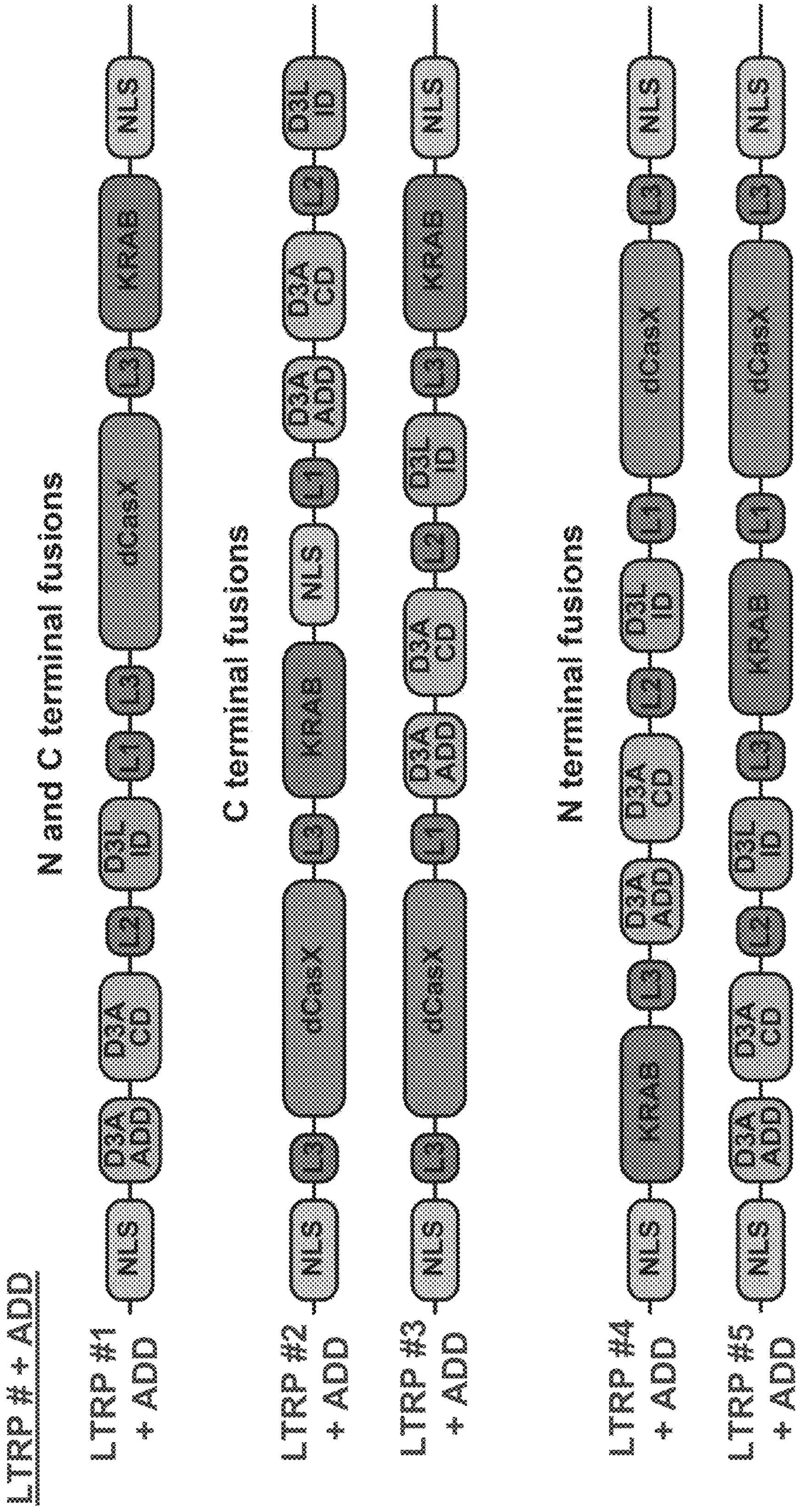
FIG. 2 illustrates schematics of various configurations of LTRP fusion proteins with the DNMT3A ADD domain incorporated. "D3A ADD", "D3A CD", and "D3L ID" denote the ADD domain of DNMT3A, the catalytic domain of DNMT3A, and the interaction domain of DNMT3L, respectively. L1-L3 are linkers. NLS is the nuclear localization signal.

In some cases, a repressor fusion protein includes (is fused to) a nuclear localization signal (NLS). In some cases, a repressor fusion protein is fused to 2 or more, 3 or more, 4 or more, or 5 or more 6 or more, 7 or more, 8 or more NLSs. In some cases, one or more NLSs (2 or more, 3 or more, 4 or more, or 5 or more NLSs) are positioned at or near (e.g., within 50 amino acids of) the N-terminus and/or the C-terminus of the repressor fusion protein. In some cases, one or more NLSs (2 or more, 3 or more, 4 or more, or 5 or more NLSs) are positioned at or near (e.g., within 50 amino acids of) the N-terminus of the repressor fusion protein. In some cases, one or more NLSs (2 or more, 3 or more, 4 or more, or 5 or more NLSs) are positioned at or near (e.g., within 50 amino acids of) the C-terminus of the repressor fusion protein. In some cases, one or more NLSs (3 or more, 4 or more, or 5 or more NLSs) are positioned at or near (e.g., within 50 amino acids of) both the N-terminus and the C-terminus of the repressor fusion protein. In some cases, a single NLS is positioned at the N-terminus and a single NLS is positioned at the C-terminus of the repressor fusion protein. The person of ordinary skill in the art will understand that an NLS at or near the N- or C-terminus of a protein can be within 1, 2, 3, 4, 5, 6, 7, 8, 9, 10, 11, 12, 13, 14, 15, 16, 17, 18, 19 or 20 amino acids of the N- or C-terminus. In some embodiments, the NLS linked to the N-terminus of the dCasX or the repressor fusion protein are identical to the NLS linked to the C-terminus. In other embodiments, the NLS linked to the N-terminus of the dCasX or the repressor fusion protein are different to the NLS linked to the C-terminus. Representative configurations of repressor fusion proteins with NLS are shown in FIG. 1 and FIG. 2. In some embodiments, NLSs suitable for use with a repressor fusion protein in the systems of the disclosure comprise sequences having at least about 85%, at least about 90%, or at least about 95% identity or are identical to sequences derived from: the NLS of the simian virus 40 (SV40) virus large T-antigen, having the amino acid sequence PKKKRKV (SEQ ID NO: 30); the NLS from nucleoplasmin (e.g., the nucleoplasmin bipartite NLS with the sequence KRPAATKKAGQAKKKK (SEQ ID NO: 31); the c-MYC NLS having the amino acid sequence PAAKRVKLD (SEQ ID NO: 32) or RQRRNELKRSP (SEQ ID NO: 33). In some embodiments, the NLS linked to the N-terminus of the repressor fusion protein is selected from the group consisting of the N-terminal sequences as set forth in Table 3. In some embodiments, the NLS linked to the C-terminus of the repressor fusion protein is selected from the group consisting of the C-terminal sequences as set forth in Table 4. In some embodiments, NLSs suitable for use with a repressor fusion protein in the systems of the disclosure include sequences having at least about 80%, at least about 90%, or at least about 95% identity or are identical to one or more sequences of Table 3 or Table 4. The skilled artisan will understand that Tables 3 and 4 present NLS sequences as N-terminal or C-terminal as exemplary embodiments. Any of the NLS in Table 3 or 4 can be fused to either the N or C terminal of a repressor fusion protein described herein.

TABLE 3

| N-terminal NLS Amino Acid Sequences | |
|---|---|
| NLS Amino Acid Sequence* | SEQ ID NO |
| **PKKKRKV**SR | 34 |
| **PKKKRKV**GGS**PKKKRKV**GGS**PKKKRKV**GGS**PKKKRKV**SR | 35 |
| **PKKKRKV**GGS**PKKKRKV**GGS**PKKKRKV**GGS**PKKKRKV**GGS**PKKKRKV**GGS**PKKKRKV** SR | 36 |
| **PAAKRVKLD**SR | 37 |
| **PAAKRVKLD**GGS**PAAKRVKLD**SR | 38 |
| **PAAKRVKLD**GGS**PAAKRVKLD**GGS**PAAKRVKLD**GGS**PAAKRVKLD**SR | 39 |
| **PAAKRVKLD**GGS**PAAKRVKLD**GGS**PAAKRVKLD**GGS**PAAKRVKLD**GGS**PAAKRVKLD** GGS**PAAKRVKLD**SR | 40 |
| **KRPAATKKAGQAKKKK**SR | 41 |
| **KRPAATKKAGQAKKKK**GGS**KRPAATKKAGQAKKKK**SR | 42 |
| **PAAKRVKLD**GGS**PKKKR**KVSR | 43 |
| **PAAKKKKLD**GGS**PKKKR**KVSR | 44 |
| **PAAKKKKLD**SR | 45 |
| **PAAKKKKLD**GGS**PAAKKKKLD**GGS**PAAKKKKLD**SR | 46 |
| **PAAKKKKLD**GGS**PAAKKKKLD**GGS**PAAKKKKLD**GGS**PAAKKKKLD**SR | 47 |
| **PAKRARRGYKC**SR | 48 |
| **PAKRARRGYKC**GS**PAKRARRGYKC**SR | 49 |
| **PRRKREE**SR | 50 |
| **PYRGRKE**SR | 51 |
| **PLRKRPRR**SR | 52 |
| **PLRKRPRR**GS**PLRKRPRR**SR | 53 |
| **PAAKRVKLD**GG**KRTADGSEFESPKKKRKV**GGS | 54 |
| **PAAKRVKLD**GG**KRTADGSEFESPKKKRKV**PPPPG | 55 |
| **PAAKRVKLD**GG**KRTADGSEFESPKKKRKV**GIHGVPAAPG | 56 |
| **PAAKRVKLD**GG**KRTADGSEFESPKKKRKV**GGGSGGGSPG | 57 |
| **PAAKRVKLD**GG**KRTADGSEFESPKKKRKV**PGGGSGGGSPG | 58 |
| **PAAKRVKLD**GG**KRTADGSEFESPKKKRKV**AEAAAKEAAAKEAAAKAPG | 59 |
| **PAAKRVKLD**GGS**PKKKRKV**GGS | 60 |
| **PAAKRVKLD**PPP**PKKKRKV**PG | 61 |
| **PAAKRVKLD**PG | 62 |
| **PAAKRVKLD**GGGSGGGSGGGS | 63 |
| **PAAKRVKLD**PPP | 64 |
| **PAAKRVKLD**GGGSGGGSGGGSPPP | 65 |
| **PKKKRKV**PPP | 66 |
| **PKKKRKV**GGS | 67 |

*Residues in bold are NLS residues, while unbolded residues are linkers.

TABLE 4

C-terminal NLS Amino Acid Sequences

| NLS Amino Acid Sequence | SEQ ID NO |
|---|---|
| GS**PKKKRKV**GGS**PKKKRKV**GGS**PKKKRKV**GGS**PKKKRKV** | 68 |
| GS**PKKKRKV**GGS**PKKKRKV**GGS**PKKKRKV**GGS**PKKKRKV**GGS**PKKKRKV**GGS**PKKKRKV** | 69 |
| **GSPAAKRVKLD**GGS**PAAKRVKLD** | 70 |
| **GSPAAKRVKLD**GGS**PAAKRVKLD**GGS**PAAKRVKLD**GGS**PAAKRVKLD** | 71 |
| GS**KRPAATKKAGQAKKKK** | 72 |
| **KRPAATKKAGQAKKKK**GGS**KRPAATKKAGQAKKKK** | 73 |
| GS**KLGPRKATGRW**GS | 74 |
| GS**KRKGSPERGERKRHW**GS | 75 |
| GS**PKKKRKV**GSGS**KRPAATKKAGQAKKKK**LE | 76 |
| GP**KRTADSQHSTPPKTKRKV**EFE**PKKKRKV** | 77 |
| GGGSGGGS**KRTADSQHSTPPKTKRKV**EFE**PKKKRKV** | 78 |
| AEAAAKEAAAKEAAAKA**KRTADSQHSTPPKTKRKV**EFE**PKKKRKV** | 79 |
| GPPKKKRKVGGS**KRTADSQHSTPPKTKRKV**EFE**PKKKRKV** | 80 |
| GPAEAAAKEAAAKEAAAKA**PAAKRVKLD** | 81 |
| GPGGGSGGGSGGGS**PAAKRVKLD** | 82 |
| GP**PAAKRVKLD** | 83 |
| VGS**KRPAATKKAGQAKKKK** | 84 |
| TGGGPGGGAAAGSGS**PKKKRKV**GSGS**KRPAATKKAGQAKKKK**LE | 85 |
| TGGGPGGGAAAGSGS**PKKKRKV**GSGS | 86 |
| PPP**PKKKRKV**PPP | 87 |
| GGS**PKKKRKV**PPP | 88 |
| PPP**PKKKRKV** | 89 |
| GGS**PKKKRKV** | 90 |
| GGS**PKKKRKV**GGSGGSGGS | 91 |
| GGS**PKKKRKV**GGS**PKKKRKV** | 92 |
| GGSGGSGGS**PKKKRKV**GGS**PKKKRKV** | 93 |
| VGGGSGGGSGGGS**PAAKRVKLD** | 94 |
| VPPP**PAAKRVKLD** | 95 |
| VPPPGGGSGGGSGGGS**PAAKRVKLD** | 96 |
| VGS**PAAKRVKLD** | 97 |

In some embodiments, the one or more NLSs are linked to the repressor fusion protein or to adjacent NLS with a linker peptide wherein the linker peptide is selected from the group consisting of SR, GS, GP, VGS, GGS, (G)n (SEQ ID NO: 98), (GS)n (SEQ ID NO: 99), (GSGGS)n (SEQ ID NO: 100), (GGSGGS)n (SEQ ID NO: 101), (GGGS)n (SEQ ID NO: 102), GGSG (SEQ ID NO: 103), GGSGG (SEQ ID NO: 104), GSGSG (SEQ ID NO: 105), GSGGG (SEQ ID NO: 106), GGGSG (SEQ ID NO: 107), GSSSG (SEQ ID NO: 108), GPGP (SEQ ID NO: 109), GGP, PPP, VPPP, PPAPPA (SEQ ID NO: 110), PPPG (SEQ ID NO: 111), PPPGPPP (SEQ ID NO: 112), PPP (GGGS)n (SEQ ID NO: 113), (GGGS)nPPP (SEQ ID NO: 114), AEAAAKEAAAKEAAAKA (SEQ ID NO: 115), VPPPGGGSGGGSGGGS (SEQ ID NO: 116), TGGGPGG-GAAAGSGS (SEQ ID NO: 117), GGGSGGGSGGGSPPP (SEQ ID NO: 118), TPPKTKRKVEFE (SEQ ID NO: 119), GGSGGGS (SEQ ID NO: 120), GSGSGGG (SEQ ID NO: 121), SSGNSNANSRGPSFSSGLVPLSLRGSH (SEQ ID NO: 122), GGPSSGAPPPSGGSPAGSPTSTEEGTSESAT-PESGPGTSTEPSEGSAPGSPAGSPTSTEEGTSTE PSEGSAPGTSTEPSE (SEQ ID NO: 123), and GGSGGG (SEQ ID NO: 124), where n is 1 to 5.

In general, NLS (or multiple NLSs) are of sufficient strength to drive accumulation of a LTRP fusion protein in the nucleus of a eukaryotic cell. Detection of accumulation in the nucleus may be performed by any suitable technique. For example, a detectable marker may be fused to a LTRP fusion protein such that location within a cell may be visualized. Cell nuclei may also be isolated from cells, the contents of which may then be analyzed by any suitable process for detecting protein, such as immunohistochemistry, Western blot, or enzyme activity assay. Accumulation in the nucleus may also be determined indirectly.

IV. Repressor Domains

In some embodiments, the disclosure provides repressor fusion proteins and systems comprising same, the repressor fusion proteins comprising a DNA-binding protein linked to multiple repressor domains (repressor fusion proteins), wherein the system is capable of binding to a target nucleic acid of PCSK9 and repressing transcription of a PCSK9 target nucleic acid, including by epigenetic modification of the target nucleic acid. Exemplary DNA-binding proteins for use in the repressor fusion proteins include zinc finger (ZF), TALE (transcription-activator-like effector) proteins, and DNA-binding proteins such as catalytically-dead CRISPR proteins.

In some embodiments, the disclosure provides repressor fusion proteins comprising a catalytically-dead CRISPR protein, such as a dCasX, linked to multiple repressor domains. When the repressor fusion protein is complexed with a guide ribonucleic acid (gRNA) comprising a targeting sequence complementary to the target nucleic acid sequence of PCSK9, wherein the system is capable of binding to a target nucleic acid of PCSK9 and repressing transcription and/or epigenetic modification of the PCSK9 target nucleic acid. Examples of gene repression processes which decrease transcription include, but are not limited to, those which inhibit formation of a transcription initiation complex, those which decrease transcription initiation rate, those which decrease transcription elongation rate, those which decrease processivity of transcription and those which antagonize transcriptional activation (by, for example, blocking the binding of a transcriptional activator). Gene repression can constitute, for example, prevention of activation as well as inhibition of expression below an existing level. Transcriptional repression includes both reversible and irreversible inactivation of gene transcription; the latter can result from epigenetic modification of the target nucleic acid.

Amongst repressor domains that have the ability to repress, or silence genes, the Krüppel-associated box (KRAB) repressor domain is amongst the most powerful in human genome systems (Alerasool, N., et al. An efficient KRAB domain for CRISPRi applications. Nat. Methods 17:1093 (2020)). KRAB domains are present in approximately 400 human zinc finger protein-based transcription factors that upon binding of the linked dCasX to the target nucleic acid, is capable of recruiting additional repressor domains such as, but not limited to, Trim28 (also known as Kap1 or Tif1-beta) that, in turn, assembles a protein complex with chromatin regulators such as CBX5/HP1α and SETDB1 that induce repression of transcription of the gene, but do so in a limited, temporal fashion. Representative, non-limiting examples of KRAB domains suitable for use in the systems of the disclosure include ZIM3 (SEQ ID NO: 128) and ZNF10 (SEQ ID NO: 129). The disclosure provides additional repressor domains that are from human and non-human sources that have been found to result in enhanced activity compared to ZIM3 and ZNF10 when incorporated in a repressor fusion proteins, described herein.

In some embodiments, the disclosure provides systems in which the modification imparted by use of the repressor fusion protein:gRNA system is epigenetic, and hence the silencing of the PCSK9 gene is heritable by mechanisms other than by replication of a target nucleic acid that has been edited. As used herein "epigenetic modification" means a modification to either DNA or histones associated with DNA, other than a change in the DNA sequence itself (e.g., a substitution, deletion or rearrangement), wherein the modification is either a direct modification by a component of the system or is indirect by the recruitment of one or more additional cellular components, but in which the DNA target nucleic acid sequence itself is not edited to change the sequence. For example, DNA methyltransferase 3A (DNMT3A) (or its catalytic domain) directly modifies the DNA by methylating it, whereas KRAB recruits KAP-1/TIF1β corepressor complexes that act as potent transcriptional repressors and can further recruit factors associated with DNA methylation and formation of repressive chromatin, such as heterochromatin protein 1 (HP1), histone deacetylases and histone methyltransferases (Ying, Y., et al. The Krüppel-associated box repressor domain induces reversible and irreversible regulation of endogenous mouse genes by mediating different chromatin states. Nucleic Acids Res. 43(3): 1549 (2015)). Further, the catalytically inactive DNMT3L cofactor helps establish a heritable methylation pattern after DNA replication, together with endogenous DNMT1 of the cell. The ATRX-DNMT3-DNMT3L domain (ADD) of DNMT3A is known to have two key functions: 1) it allosterically regulates the catalytic activity of DNMT3A by serving as a methyltransferase auto-inhibitory domain, and 2) it specifically interacts with histone H3 tails that are unmethylated at lysine (K) 4, leading to the preferential methylation of DNA bound to chromatin H3 tails that are unmethylated at K4 (Zhang, Y., et al. Chromatin methylation activity of Dnmt3a and Dnmt3a/3L is guided by interaction of the ADD domain with the histone H3 tail. Nucleic Acids Research 38:4246 (2010)).

In some embodiments, the repressor fusion protein (or the mRNA encoding the repressor fusion protein) comprises a DNA-binding protein linked to a first, second, third, and fourth repressor domain, wherein each of the repressor domains are different. In some embodiments, the DNA-binding protein is a TALE that can bind but not cleave the target nucleic acid. In some embodiments, the DNA-binding protein is a zinc-finger protein that can bind but not cleave the target nucleic acid. In some embodiments, the DNA-binding protein is a catalytically dead CRISPR protein that can bind but not cleave the target nucleic acid. In some embodiments, the repressor fusion protein (or the mRNA encoding the repressor) comprises a catalytically-dead CasX sequence, a first repressor domain (herein after referred to as "RD1"), a DNMT3A catalytic domain (herein after referred to as "DNMT3A") as the second domain, a DNMT3L interaction domain (herein after referred to as "DNMT3L") as the third domain, and an ATRX-DNMT3-DNMT3L domain (herein after referred to as "ADD") as the fourth domain. In some embodiments, the ADD is fused to the N-terminus of the DNMT3A. In some embodiments, the repressor fusion protein comprises a first and a second NLS and one or more linker peptides described herein, and the fusion protein is capable of forming an RNP with a gRNA of the system that binds to the target nucleic acid.

It has been discovered that the use of the foregoing domains, when configured in select orientations relative to a dCasX in a repressor fusion protein, results in pronounced epigenetic modification of a PCSK9 target nucleic acid when complexed with a gRNA with a targeting sequence complementary to defined regions of the PCSK9 gene, and that the combination of the repressor domains work in synchrony, resulting in an additive or synergistic effect on transcriptional silencing of the targeted gene, depending on the configuration. In one embodiment of the foregoing, the dCasX of the repressor fusion protein comprises a sequence selected from the group consisting of SEQ ID NOS: 4-29, or a sequence having at least about 80%, at least about 90%, at least about 91%, at least about 92%, at least about 93%, at least about 94%, at least about 95%, at least about 96%, at least about 97%, at least about 98%, at least about 99% identity thereto. In another embodiment of the foregoing, the first repressor domain (RD1) of the repressor fusion protein comprises a sequence selected from the group consisting of SEQ ID NOS: 128-1726, or a sequence having at least about 80%, at least about 90%, at least about 91%, at least about 92%, at least about 93%, at least about 94%, at least about 95%, at least about 96%, at least about 97%, at least about 98%, at least about 99% identity thereto. In another embodiment of the foregoing, the RD1 of the repressor fusion protein comprises a sequence selected from the group consisting of SEQ ID NOS: 130-224 or a sequence having at least about 80%, at least about 90%, at least about 91%, at least about 92%, at least about 93%, at least about 94%, at least about 95%, at least about 96%, at least about 97%, at least about 98%, at least about 99% identity thereto. In another embodiment of the foregoing, the first repressor domain (RD1) of the repressor fusion protein comprises a sequence selected from the group consisting of SEQ ID NOS: 130-138 or a sequence having at least about 80%, at least about 90%, at least about 91%, at least about 92%, at least about 93%, at least about 94%, at least about 95%, at least about 96%, at least about 97%, at least about 98%, at least about 99% identity thereto. In another embodiment of the foregoing, the RD1 of the repressor fusion protein comprises a sequence selected from the group consisting of SEQ ID NOS: 135 or a sequence having at least about 80%, at least about 90%, at least about 91%, at least about 92%, at least about 93%, at least about 94%, at least about 95%, at least about 96%, at least about 97%, at least about 98%, at least about 99% identity thereto. In another embodiment of the foregoing, the RD1 of the repressor fusion protein comprises a sequence selected from the group consisting of SEQ ID NOS: 131 or a sequence having at least about 80%, at least about 90%, at least about 91%, at least about 92%, at least about 93%, at least about 94%, at least about 95%, at least about 96%, at least about 97%, at least about 98%, at least about 99% identity thereto. In another embodiment of the foregoing, the second repressor domain of the repressor fusion protein is a DNMT3A, comprising a sequence of SEQ ID NO: 126, or a sequence having at least about 80%, at least about 90%, at least about 91%, at least about 92%, at least about 93%, at least about 94%, at least about 95%, at least about 96%, at least about 97%, at least about 98%, at least about 99% identity thereto. In another embodiment of the foregoing, the third repressor domain of the repressor fusion protein is a DNMT3L, comprising a sequence of SEQ ID NO: 127, or a sequence having at least about 80%, at least about 90%, at least about 91%, at least about 92%, at least about 93%, at least about 94%, at least about 95%, at least about 96%, at least about 97%, at least about 98%, at least about 99% identity thereto. In another embodiment of the foregoing, the fourth repressor domain of the repressor fusion protein is an ADD, comprising a sequence of SEQ ID NO: 125, or a sequence having at least about 80%, at least about 90%, at least about 91%, at least about 92%, at least about 93%, at least about 94%, at least about 95%, at least about 96%, at least about 97%, at least about 98%, at least about 99% identity thereto. In a surprising finding, it has been discovered that the addition of the ADD to the repressor fusion proteins comprising the RD1, DNMT3A, and DNMT3L greatly enhances or increases the long-term repression and/or epigenetic modification of the target nucleic acid, as well as the specificity of the repression, in comparison to repressor fusion proteins lacking the ADD. Exemplary data for the improved repression and specificity of repressor fusion proteins comprising the ADD are presented in the Examples. Exemplary configurations of repressor fusion proteins comprising the ADD are presented in FIG. 2.

In some embodiments, the present disclosure provides a system of an repressor fusion protein comprising a first, a second, a third, and a fourth repressor domain operably linked to a dCasX comprising the sequence of SEQ ID NO: 4, or a sequence having at least about 65%, at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the RD1 comprises one or more motifs selected from the group consisting of a) $PX_1X_2X_3X_4X_5X_6EX_7$, wherein $X_1$ is A, D, E, or N, $X_2$ is L or V, $X_3$ is I or V, $X_4$ is S, T, or F, $X_5$ is H, K, L, Q, R or W, $X_6$ is L or M, and $X_7$ is G, K, Q, or R; b) $X_1X_2X_3X_4GX_5X_6X_7X_8X_9$, wherein $X_1$ is L or V, $X_2$ is A, G, L, Tor V, $X_3$ is A, F, or S, $X_4$ is L or V, $X_5$ is C, F, H, I, L or Y, $X_6$ is A, C, P, Q, or S, $X_7$ is A, F, G, I, S, or V, $X_8$ is A, P, S, or T, and $X_9$ is K or R; c) $QX_1X_2LYRX_3VMX_4$ (SEQ ID NO: 1727), wherein $X_1$ is K or R, $X_2$ is A, D, E, G, N, S, or T, $X_3$ is D, E, or S, and $X_4$ is L or R; d) $X_1X_2X_3FX_4DVX_5X_6X_7FX_8X_9X_{10}X_1$ (SEQ ID NO: 1728), wherein $X_1$ is A, L, P, or S, $X_2$ is L or V, $X_3$ is S or T, $X_4$ is A, E, G, K, or R, $X_5$ is A or T, $X_6$ is I or V, $X_7$ is D, E, N, or Y, $X_8$ is S or T, $X_9$ is E, P, Q, R, or W, $X_{10}$ is E or N, and $X_{11}$ is E or Q; c) $X_1X_2X_3PX_4X_5X_6X_7X_8X_9X_{10}$, wherein $X_1$ is E, G, or R, $X_2$ is E or K, $X_3$ is A, D, or E, $X_4$ is C or W, $X_5$ is I, K, L, M, T, or V, $X_6$ is I, L, P, or V, $X_7$ is D, E, K, or V, $X_8$ is E, G, K, P, or R, $X_9$ is A, D, R, G, K, Q, or V, and $X_{10}$ is D, E, G, I, L, R, S, or V; f) $LYX_1X_2VMX_3EX_4X_5X_6X_7X_8X_9X_{10}$ (SEQ ID NO: 1729), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S; g) $FX_1DVX_2X_3X_4FX_5X_6X_7EWX_8$ (SEQ ID NO: 1730), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R; h) $X_1PX_2X_3X_4X_5\ X_6LEX_7X_8X_9X_{10}X_{11}X_{12}$, wherein $X_1$ is Kor R, $X_2$ is A, D, E, or N, $X_3$ is I, L, M, or V, $X_4$ is I or V, $X_5$ is F, S, or T, $X_6$ is H, K, L, Q, R, or W, $X_7$ is K, Q, or R, $X_8$ is E, G, or R, $X_9$ is D, E, or K, $X_{10}$ is A, D, or E, $X_{11}$ is L or P, and $X_{12}$ is C or W; and i) $X_1LX_2X_3X_4QX_5X_6$, wherein $X_1$ is C, H, L, Q, or W, $X_2$ is D, G, N, R, or S, $X_3$ is L, P, S, or T, $X_4$ is A, S, or T, $X_5$ is K or R, and $X_6$ is A, D, E, K, N, S, or T; or comprises a first and a second motif wherein the first amino acid sequence motif comprises a) $LYX_1X_2VMX_3EX_4X_5X_6X_7X_8X_9X_{10}$ (SEQ ID NO: 1729), wherein (i) $X_1$ is K or R, (ii) $X_2$ is D or E, (iii) $X_3$ is L, Q, or R, (iv) $X_4$ is N or T, (v) $X_5$ is F or Y, (vi) $X_6$ is A, E, G, Q, R, or S, (vii) $X_7$ is H, L, or N, (viii) $X_8$ is L or V, (ix) $X_9$ is A, G, I, L, T, or V, and (x) $X_{10}$ is A, F, or S; and b) the second amino acid sequence motif comprises $FX_1DVX_2X_3X_4FX_5X_6X_7EWX_8$ (SEQ ID NO: 1730), wherein (i) $X_1$ is A, E, G, K, or R, (ii) $X_2$ is A, S, or T, (iii) $X_3$ is I or V, (iv) $X_4$ is D, E, N, or Y, (iv) $X_5$ is S or T, (v) $X_6$ is E, L, P, Q, R, or W, (vi) $X_7$ is D or E, and (vii) $X_8$ is A, E, G, Q, or R; or comprises an amino acid sequence motif selected from the group consisting of: a) DVAVYFSPEEWGCL (SEQ ID NO: 2945); b) $X_1X_2X_3QX_4X_5LY$, wherein (i) $X_1$ is A, D, G, N, R, or S, (ii) $X_2$ is P, S, or T, (iii) $X_3$ is A, S, or T, (iv) $X_4$ is K or R, and (v) $X_5$ is A, D, K, N, S, or T; c) $X_1KPX_2X_3X_4X_5X_6$, wherein (i) $X_1$ is A, P, or S, (ii) $X_2$ is A, D, or E, (iii) $X_3$ is L, M, or V, (iv) $X_4$ is I or V, (v) $X_5$ is F, S, or T, and (vi) $X_6$ is H, K, L, Q, R, or W; d) $LEX_1X_2X_3X_4X_5X_6$, wherein (i) $X_1$ is E, K, Q or R, (ii) $X_2$ is E, G, or R, (iii) $X_3$ is A, D, E, or K, (iv) $X_4$ is A, D, or E, (v) $X_5$ is L or P, and (vi) $X_6$ is C or W; and c) $X_1VMLEX_2YX_3X_4X_5X_6SX_7X_8X_9$ (SEQ ID NO: 2946), wherein (i) $X_1$ is D or E, (ii) $X_2$ is N or T, (iii) $X_3$ is A, E, G, Q, R, or S, (iv) $X_4$ is H or N, (v) $X_5$ is L, M, or V, (vi) $X_6$ is A, L, or V, (vii) $X_7$ is L or V, (ix) $X_8$ is A, G, or V, and (x) $X_9$ is C, F, or L, and the second repressor domain is a DNMT3A sequence comprises the sequence of SEQ ID NO: 126, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the third repressor is a DNMT3L comprising the sequence of SEQ ID NO: 127, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the fourth repressor is an ADD comprising the sequence of SEQ ID NO: 125, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the fusion protein comprises one or more linker peptides described herein, and wherein the fusion protein is capable of forming an RNP with a gRNA of the system that binds to the target nucleic acid. In some embodiments of the foregoing, the RD1 comprises a sequence selected from the group consisting of SEQ ID NOS: 130-1726, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the second repressor domain is a DNMT3A sequence comprises the sequence of SEQ ID NO: 126, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the third repressor is a DNMT3L comprising the sequence of SEQ ID NO: 127, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the fourth repressor is an ADD comprising the sequence of SEQ ID NO: 125, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the fusion protein comprises one or more linker peptides described herein, and wherein the fusion protein is capable of forming an RNP with a gRNA of the system that binds to the target nucleic acid. In other embodiments of the foregoing, the first RD1 comprises a sequence selected from the group consisting of SEQ ID NOS: 130-224, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In other embodiments of the foregoing, the first RD1 comprises a sequence selected from the group consisting of SEQ ID NOS: 130-138, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In other embodiments of the foregoing, the first RD1 comprises the sequence of SEQ ID NO: 135, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In other embodiments of the foregoing, the first RD1 comprises the sequence of SEQ ID NO: 131, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In the foregoing embodiments, the fusion protein can comprise a first and a second NLS comprising a sequence selected from the group consisting of SEQ ID NOS: 30-97, and one or more linker peptides comprising a sequence selected from the group consisting of SEQ ID NOS: 98-124, as set forth in Table 5. In the foregoing embodiments of the paragraph, the repressor fusion protein is capable of forming an RNP complex with a gRNA of the system that is capable of binding to the gene target nucleic acid.

The skilled artisan will understand that RD1 proteins comprising the motifs described supra, with one or more conservative substitutions to the motif, may also function as RD1 domains and are envisaged as within the scope of the instant disclosure.

In some embodiments, the repressor fusion protein comprises, from N- to C-terminus, an RD1, an ADD, a DNMT3A, a DNMT3L, and a DNA-binding protein. In some embodiments, the repressor fusion protein comprises, from N- to C-terminus, an RD1, an ADD, a DNMT3A, a DNMT3L, and a catalytically-dead CRISPR protein. In some embodiments, the repressor fusion protein comprises, from N- to C-terminus, an RD1, an ADD, a DNMT3A, a DNMT3L, and a dCasX.

In some embodiments, the repressor fusion protein comprises, from N- to C-terminus, an ADD, a DNMT3A, a DNMT3L, an RD1, and a DNA-binding protein. In some embodiments, the repressor fusion protein comprises, from N- to C-terminus, an ADD, a DNMT3A, a DNMT3L, an RD1, and a catalytically-dead CRISPR protein. In some embodiments, the repressor fusion protein comprises, from N- to C-terminus, an ADD, a DNMT3A, a DNMT3L, an RD1, and a dCasX.

In some embodiments, the repressor fusion protein has a configuration of, N-terminal to C-terminal of NLS-ADD-DNMT3A-DNMT3L-dCasX-RD1-NLS, NLS-dCasX-RD1-NLS-ADD-DNMT3A-DNMT3L, NLS-dCasX-ADD-DNMT3A-DNMT3L-RD1-NLS), NLS-RD-ADD-DNMT3A-DNMT3L-dCasX-NLS, or NLS-ADD-DNMT3A-DNMT3L-RD1-dCasX-NLS. In any of the foregoing, a linker peptide may be inserted between one or more of the ADD, DNMT3A, DNMT3L, RD1 or dCasX domains.

In some embodiments, the repressor fusion protein has a configuration of, N-terminal to C-terminal, of configuration 1 (NLS-ADD-DNMT3A-Linker2-DNMT3L-Linker1-Linker3A-dCasX-Linker3B-RD1-NLS), configuration 2 (NLS-Linker3A-dCasX-Linker3B-RD1-NLS-Linker1-ADD-DNMT3A-Linker2-DNMT3L), configuration 3 (NLS-Linker3A-dCasX-Linker1-ADD-DNMT3A-Linker2-DNMT3L-Linker3B-RD1-NLS), configuration 4 (NLS-RD1-Linker3A-ADD-DNMT3A-Linker2-DNMT3L-Linker1-dCasX-Linker3B-NLS), or configuration 5 (NLS-ADD-DNMT3A-Linker2-DNMT3L-Linker3A-RD1-Linker1-dCasX-Linker3B-NLS). In some embodiments, the repressor fusion protein has a configuration of, N-terminal to C-terminal, of configuration 1' (NLS-DNMT3A-Linker2-DNMT3L-Linker1-Linker3A-dCasX-Linker3B-RD1-NLS), configuration 2' (NLS-Linker3A-dCasX-Linker3B-RD1-NLS-Linker1-DNMT3A-Linker2-DNMT3L), configuration 3' (NLS-Linker3A-dCasX-Linker1-DNMT3A-Linker2-DNMT3L-Linker3B-RD1-NLS), configuration 4' (NLS-RD1-Linker3A-DNMT3A-Linker2-DNMT3L-Linker1-dCasX-Linker3B-NLS), or configuration 5' (NLS-DNMT3A-Linker2-DNMT3L-Linker3A-RD1-Linker1-dCasX-Linker3B-NLS). The skilled artisan will appreciate that configurations 1'-5' correspond to configurations 1-5 without the ADD domain. In some embodiments of the system, the fusion protein components of the system are configured as schematically portrayed in FIG. 1 or FIG. 2. In the foregoing embodiment of configurations 1-5 or 1'-5', the NLS comprise a sequence selected from the group consisting of SEQ ID NOS: 30-97 and the linker sequences are independently selected from the group consisting of SEQ ID NOS: 98-124 as set forth in Table 5. In some embodiments, the linker sequences are independently selected from the group consisting of SEQ ID NOS 120-123. In some embodiments, Linker 1 comprises a sequence of SEQ ID NOS: 123. In some embodiments, Linker 2 comprises a sequence of SEQ ID NO: 122. In some embodiments, Linker 3A and/or Linker 3B comprise a sequence of SEQ ID NO: 120. In some embodiments, Linker 4 comprises a sequence of SEQ ID NO: 121.

TABLE 5

Exemplary linker amino acid sequences for LTRP fusion proteins

| Amino Acid Sequence* | SEQ ID NO |
|---|---|
| (G)n | 98 |
| (GS)n | 99 |
| (GSGGS)n | 100 |
| (GGSGGS)n | 101 |
| (GGGS)n | 102 |
| GGSG | 103 |
| GGSGG | 104 |
| GSGSG | 105 |
| GSGGG | 106 |
| GGGSG | 107 |
| GSSSG | 108 |
| GPGP | 109 |
| PPAPPA | 110 |
| PPPG | 111 |
| PPPGPPP | 112 |
| PPP(GGGS)n | 113 |
| (GGGS)nPPP | 114 |
| AEAAAKEAAAKEAAAKA | 115 |
| VPPPGGGSGGGSGGGS | 116 |
| TGGGPGGGAAAGSGS | 117 |
| GGGSGGGSGGGSPPP | 118 |

TABLE 5-continued

| Exemplary linker amino acid sequences for LTRP fusion proteins | |
|---|---|
| Amino Acid Sequence* | SEQ ID NO |
| TPPKTKRKVEFE | 119 |
| GGSGGGS | 120 |
| GSGSGGG | 121 |
| SSGNSNANSRGPSFSSGLVPLSLRGSH | 122 |
| GGPSSGAPPPSGGSPAGSPTSTEEGTSESATPESGPGTSTE PSEGSAPGSPAGSPTSTEEGTSTEPSEGSAPGTSTEPSE | 123 |
| GGSGGG | 124 |

*n is 1 to 5

In some embodiments of the repressor fusion proteins and systems comprising same, the repressor fusion protein comprises a DNA-binding protein, a first, second, third, and fourth repressor domain configured as a configuration selected from the group consisting of configuration 1, configuration 2, configuration 3, configuration 4, configuration 5, configuration 1', configuration 2', configuration 3,' configuration 4', and configuration 5', described supra, upon binding of an RNP of the repressor fusion protein and the gRNA with a targeting sequence complementary to the PCSK9 target nucleic acid in a cell, the target nucleic acid is epigenetically-modified and transcription of the PCSK9 gene is repressed. In some embodiments, transcription of the PCSK9 gene is repressed by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99%, when assayed in an in vitro assay, including cell-based assays, when compared to untreated cells or cells treated with a comparable system comprising a non-targeting spacer. Most preferably, PCSK9 gene repression results in complete inhibition of gene expression, such that no gene product is detectable. In some embodiments, transcription of the PCSK9 gene of at least about 1%, at least about 2%, at least about 3%, at least about 4%, at least about 5%, at least about 6%, at least about 7%, at least about 8%, at least about 9%, or at least about 10%, at least about 20%, at least about 30%, at least about 40%, at least about 50%, at least about 60% or more of cells of a population targeted by the repressor fusion protein:gRNA system are repressed.

In some embodiments, the repression of transcription of the PCSK9 gene is sustained for at least about 8 hours, at least about 1 day, at least about 7 days, at least 2 weeks, at least about 3 weeks, at least about 1 month, or at least about 2 months, when assayed in an in vitro assay, including cell-based assays. In some embodiments, the repression of transcription of the PCSK9 gene is sustained for at least about 7 days, at least 2 weeks, at least about 3 weeks, at least about 1 month, at least about 2 months, at least about 3 months, at least about 4 months, at least about 5 months, or at least about 6 months in targeted cells of a subject when the composition is administered as a therapeutically effective dose, wherein the subject is selected from the group consisting of mouse, rat, pig, non-human primate, and human. In a particular embodiment, repressor fusion proteins configurations 4 and 5, or 4' and 5', when used in the repressor fusion protein:gRNA system, result in less off-target methylation or off-target activity in an in vitro assay compared to configuration 1. In some embodiments, use of the repressor fusion protein configurations 4 and 5, or 4' and 5', when used in a repressor fusion protein:gRNA system, results in off-target methylation or off-target activity that is less than about 10%, less than about 9%, less than about 8%, less than about 7%, less than about 6%, less than about 5%, less than about 4%, less than about 3%, less than about 2%, less than about 1%, less that 0.5%, or less than 0.1% in the cells.

a. mRNA Compositions Encoding LTRP Fusion Proteins

In another aspect, the disclosure relates to messenger RNA (mRNA) compositions comprising sequences that encode DNA-binding protein (e.g., dCasX) and linked repressor domain fusion proteins (repressor fusion proteins) of the disclosure. The mRNA compositions can be used in the repressor fusion protein:gRNA systems of the disclosure, and in certain delivery formulations; e.g., particles such as lipid nanoparticles (LNP). In some embodiments, the compositions have been designed to result in one or more of improved expression, reduced immunogenicity, increased stability, and enhanced manufacturability of the repressor fusion protein relative to repressor fusion proteins encoded by unmodified mRNAs. In some embodiments, the repressor fusion proteins are designed to result in heritable repression, wherein the repression of the PCKS9 gene persists for at least 1, 2, 3, 4, 5, or 6 or more cell divisions. In some embodiments, the repressor fusion proteins result in repression of transcription of the PCSK9 gene that is sustained for at least about 8 hours, at least about 1 day, at least about 7 days, at least 2 weeks, at least about 3 weeks, at least about 1 month, or at least about 2 months, when assayed in an in vitro assay. The disclosure also provides methods utilized to design the compositions, and formulations to deliver the compositions.

Modifications to an mRNA sequence can affect mRNA stability, protein translation and expression levels, and immunogenicity, and therefore can have a significant impact on the efficacy of mRNA-based delivery. Optimization of coding sequences and untranslated regions (UTRs) may be particularly significant when delivering an mRNA encoding a protein of interest, as opposed to a DNA template that would be transcribed into an mRNA. DNA templates are long-lived, can replicate, and can produce many RNA transcripts over their lifetimes. For DNA templates, efficiency of transcription and pre-mRNA processing are major determinants of protein expression levels. In contrast, mRNAs generally have a much shorter half-life, on the order of hours, as they are vulnerable to degradation in the cytoplasm, and cannot produce more copies of themselves. As such, mRNA stability and translation efficiency are determinants of protein expression levels for mRNA-based delivery, and the specific sequences of UTRs and coding sequences that dictate mRNA stability and translation efficiency can therefore be enhanced to improve the efficacy of mRNA-based delivery.

In some embodiments, the disclosure provides an mRNA encoding dCasX 515 (SEQ ID NO: 6) for incorporation into an mRNA encoding a repressor fusion protein, or a sequence having at least about 70%, at least about 80%, at least about 85%, at least about 90%, at least about 95%, at least about 96%, at least about 97%, at least about 98%, or having at least about 99% sequence identity thereto. In some embodiments, the disclosure provides an mRNA encoding dCasX 812 (SEQ ID NO: 29) for incorporation into an mRNA encoding a repressor fusion protein, or a sequence having at least about 70%, at least about 80%, at least about 85%, at least about 90%, at least about 95%, at least about 96%, at least about 97%, at least about 98%, or having at least about 99% sequence identity thereto. In some embodiments, the disclosure provides an mRNA sequence encoding dCasX 491 (SEQ ID NO: 4) for incorporation into an mRNA encoding a repressor fusion protein of the disclosure, or a sequence having at least about 70%, at least about 80%, at least about 85%, at least about 90%, at least about 95%, at least about 96%, at least about 97%, at least about 98%, or having at least about 99% sequence identity thereto. In some embodiments, the disclosure provides an mRNA encoding dCasX 676 (SEQ ID NO: 28) for incorporation into an mRNA encoding a repressor fusion protein, or a sequence having at least about 70%, at least about 80%, at least about 85%, at least about 90%, at least about 95%, at least about 96%, at least about 97%, at least about 98%, or having at least about 99% sequence identity thereto. In some embodiments, the disclosure provides an mRNA encoding a repressor fusion protein comprising dCasX 491 comprising a sequence of SEQ ID NO: 3122.

Various naturally-occurring or modified nucleosides may be used to produce mRNA according to the present disclosure. In some embodiments, an mRNA is or comprises natural nucleosides (e.g., adenosine, guanosine, cytidine, uridine); nucleoside analogs (e.g., 2-aminoadenosine, 2-thiothymidine, inosine, pyrrolo-pyrimidine, 3-methyl adenosine, 5-methylcytidine, C-5 propynyl-cytidine, C-5 propynyl-uridine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, pseudouridine, (e.g., N-1-methyl-pseudouridine), 2-thiouridine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages). In some embodiments, the mRNA comprises one or more nonstandard nucleotide residues. The nonstandard nucleotide residues may include, e.g., 5-methyl-cytidine ("5 mC"), pseudouridine ("ψU"), and/or 2-thio-uridine ("2sU"). In a particular embodiment, one or more of the uridine residues of the mRNA of the disclosure are replaced with N1-methyl-pseudouridine. Sec, e.g., U.S. Pat. No. 8,278,036 or WO2011012316, incorporated by reference herein, for a discussion of such residues and their incorporation into mRNA. In some embodiments, the mRNA encoding CasX 515 has N1-methyl-pseudouridine nucleosides replacing one or more, or all uridines in the sequence. In some embodiments, the mRNA encoding CasX 812 has N1-methyl-pseudouridine nucleosides replacing one or more, or all uridines in the sequence.

In some embodiments, the mRNA sequence encoding the repressor fusion protein comprises a 5' UTR and a 3' UTR sequence. The person of ordinary skill in the art will be able to select appropriate UTR sequences. In some embodiments, the 3' UTR comprises a sequence of SEQ ID NOS: 3189, 3205-3209 or 3278. In some embodiments, the 5' UTR comprises a sequence of SEQ ID NOS: 3200-3204 or 3274.

V. Guide Nucleic Acids of the Systems

In another aspect, the disclosure relates to guide ribonucleic acids (gRNA) comprising a scaffold and a linked targeting sequence complementary to (and are therefore able to hybridize with) a target nucleic acid sequence of a PCSK9 gene that have utility in repression of transcription of the PCSK9 target nucleic acid in a eukaryotic cell. As used herein, the term "gRNA" covers naturally-occurring molecules and gRNA variants, including chimeric gRNA variants comprising domains from different gRNA. gRNAs of the disclosure comprise a scaffold and a targeting sequence complementary to a target nucleic acid of a cell.

In some embodiments, the disclosure provides systems comprising an mRNA encoding a repressor fusion protein comprising a dCasX protein, and one or more gRNAs as a repressor fusion protein:gRNA system designed, upon expression of the dCasX protein in a transfected cell, to form a ribonucleoprotein (RNP) complex with the gRNA. The RNP targets and binds to specific locations in the target nucleic acid sequence of the cell for repression of transcription. The gRNA provides target specificity to the RNP complex by including a targeting sequence (or "spacer") comprising a nucleotide sequence that is complementary to a sequence of the target nucleic acid sequence. The repressor fusion protein of the system provides the site-specific activity, such as the binding and repression of the target sequence, and is guided to a target site (e.g., stabilized at a target site) within a target nucleic acid sequence by virtue of its association with the gRNA in the RNP.

Embodiments of gRNAs and formulations of mRNAs and gRNAs for use in the repression and/or epigenetic modification of PCSK9 target nucleic acids are described herein, below.

a. Reference gRNA and gRNA Variants

As used herein, a "reference gRNA" refers to a CRISPR guide ribonucleic acid comprising a wild-type sequence of a naturally-occurring gRNA. In some embodiments, a gRNA scaffold of the disclosure may be subjected to one or more mutagenesis methods, such as the mutagenesis methods described in WO2022120095A1 and WO2020247882A1, incorporated by reference herein, which may include Deep Mutational Evolution (DME), deep mutational scanning (DMS), error prone PCR, cassette mutagenesis, random mutagenesis, staggered extension PCR, gene shuffling, domain swapping, or chemical modification to generate one or more gRNA variants with enhanced or varied properties relative to the gRNA scaffold that was modified. The activity of the gRNA scaffold from which a gRNA variant was derived may be used as a benchmark against which the activity of the gRNA variant is compared, thereby measuring improvements in function or other characteristics of the gRNA scaffold.

Table 6 provides the sequences of reference gRNA tracr and scaffold sequences. In some embodiments, the disclosure provides gRNA sequences wherein the gRNA has a scaffold comprising a sequence having one or more nucleotide modifications relative to a reference gRNA sequence of any one of SEQ ID NOS: 1731-1743 of Table 6.

TABLE 6

| Reference gRNA tracr and scaffold sequences | |
|---|---|
| SEQ ID NO. | Nucleotide Sequence |
| 1731 | ACAUCUGGCGCGUUUAUUCCAUUACUUUGGAGCCAGUCCCAGCGACUAUGUCG UAUGGACGAAGCGCUUAUUUAUCGGAGAGAAACCGAUAAGUAAAACGCAUCAA AG |
| 1732 | UACUGGCGCUUUUAUCUCAUUACUUUGAGAGCCAUCACCAGCGACUAUGUCGU AUGGGUAAAGCGCUUAUUUAUCGGAGAGAAAUCCGAUAAAUAAGAAGCAUCAA AG |
| 1733 | ACAUCUGGCGCGUUUAUUCCAUUACUUUGGAGCCAGUCCCAGCGACUAUGUCG UAUGGACGAAGCGCUUAUUUAUCGGAGA |
| 1734 | ACAUCUGGCGCGUUUAUUCCAUUACUUUGGAGCCAGUCCCAGCGACUAUGUCG UAUGGACGAAGCGCUUAUUUAUCGG |
| 1735 | UACUGGCGCUUUUAUCUCAUUACUUUGAGAGCCAUCACCAGCGACUAUGUCGU AUGGGUAAAGCGCUUAUUUAUCGGAGA |
| 1736 | UACUGGCGCUUUUAUCUCAUUACUUUGAGAGCCAUCACCAGCGACUAUGUCGU AUGGGUAAAGCGCUUAUUUAUCGG |
| 1737 | GUUUACACACUCCCUCUCAUAGGGU |
| 1738 | GUUUACACACUCCCUCUCAUGAGGU |
| 1739 | UUUUACAUACCCCCUCUCAUGGGAU |
| 1740 | GUUUACACACUCCCUCUCAUGGGGG |
| 1741 | CCAGCGACUAUGUCGUAUGG |
| 1742 | GCGCUUAUUUAUCGGAGAGAAAUCCGAUAAAUAAGAAGC |
| 1743 | GGCGCUUUUAUCUCAUUACUUUGAGAGCCAUCACCAGCGACUAUGUCGUAUGG GUAAAGCGCUUAUUUAUCGGA |

targeter and the activator portions each have a duplex-forming segment that have complementarity with one another and hybridize to one another to form a double stranded duplex (dsRNA duplex for a gRNA). The term "targeter" or "targeter RNA" is used herein to refer to a crRNA-like molecule (crRNA: "CRISPR RNA") of a CasX b. gRNA Domains and their Functions The gRNAs of the disclosure comprise two segments: a targeting sequence and a protein-binding segment. The targeting segment of a gRNA includes a nucleotide sequence (referred to interchangeably as a spacer, a targeter, or a targeting sequence) that is complementary to (and therefore hybridizes with) a specific sequence (a target site) within the target nucleic acid sequence (e.g., a strand of a double stranded target DNA, a target ssRNA, a target ssDNA, etc.), described more fully below. The targeting sequence of a gRNA is capable of binding to a target nucleic acid sequence, including, in the context of the present disclosure, a coding sequence, a complement of a coding sequence, a non-coding sequence, and to accessory elements. The protein-binding segment (or "activator" or "protein-binding sequence") of the gRNA interacts with (e.g., binds to) a CasX protein as a complex, forming an RNP (described more fully, below). As used herein, "scaffold" refers to all parts to the guide with the exception of the targeting sequence, which is comprised of several regions, described more fully, below. The properties and characteristics of CasX gRNA, both wild-type and variants, are described in WO2020247882A1, US20220220508A1, and WO2022120095A1, incorporated by reference herein.

In the case of a reference gRNA, the gRNA occurs naturally as a dual guide RNA (dgRNA), wherein the dual guide RNA (and therefore of a CasX single guide RNA when the "activator" and the "targeter" are linked together, e.g., by intervening nucleotides). The crRNA has a 5' region that anneals with the tracrRNA followed by the nucleotides of the targeting sequence. In the case of the gRNA for use in the systems of the disclosure, the scaffolds are designed such that the activator and targeter portions are covalently linked to one another (rather than hybridizing to one another) and comprise a single molecule, and can be referred to as a "single-molecule gRNA," "single guide RNA", a "single-molecule guide RNA," a "one-molecule guide RNA", or a "sgRNA". The gRNA variants of the disclosure for use in the systems are all single molecule versions.

Collectively, the assembled gRNAs of the disclosure comprise distinct structured regions, or domains: the RNA triplex, the scaffold stem loop, the extended stem loop, the pseudoknot, and the targeting sequence that, in the embodiments of the disclosure is specific for a target nucleic acid and is located on the 3' end of the gRNA. The RNA triplex, the scaffold stem loop, the pseudoknot and the extended stem loop, together with the unstructured triplex loop that bridges portions of the triplex, together, are referred to as the "scaffold" of the gRNA. In some cases, the scaffold stem further comprises a bubble. In other cases, the scaffold further comprises a triplex loop region. In still other cases, the scaffold further comprises a 5' unstructured region. In some embodiments, the gRNA scaffolds of the disclosure for use in the repressor fusion protein:gRNA systems comprise a scaffold stem loop having the sequence of CCAGCGAC-UAUGUCGUAGUGG (SEQ ID NO: 1822), or a sequence with at least 1, 2, 3, 4 or 5 mismatches thereto.

Each of the structured domains are critical to establish the global RNA fold of the guide and retain functionality of the guide; particularly the ability to properly complex with the dCasX protein. For example, the guide scaffold stem interacts with the helical I domain of dCasX protein, while residues within the triplex, triplex loop, and pseudoknot stem interact with the OBD of the dCasX protein. Together, these interactions confer the ability of the guide to bind and form an RNP with the dCasX that retains stability, while the spacer (or targeting sequence) directs and defines the specificity of the RNP for binding a specific sequence of DNA.

Site-specific binding of a target nucleic acid sequence (e.g., genomic DNA) by the dCasX protein can occur at one or more locations (e.g., a sequence of a target nucleic acid) determined by base-pairing complementarity between the targeting sequence of the gRNA and the target nucleic acid sequence. Thus, for example, the gRNA of the disclosure have sequences complementarity to and therefore can hybridize with the target nucleic acid that is adjacent to a sequence complementary to a TC protospacer adjacent motif (PAM) motif or a PAM sequence, such as ATC, CTC, GTC, or TTC. Because the targeting sequence of a guide sequence hybridizes with a sequence of a target nucleic acid sequence, a targeting sequence can be modified by a user to hybridize with a specific target nucleic acid sequence, so long as the location of the PAM sequence is considered. In some embodiments, for design of a targeting sequence, the target nucleic acid comprises a PAM sequence located 5' of the targeting sequence with at least a single nucleotide separating the PAM from the first nucleotide of the target nucleic acid complementary to that of the targeting sequence. In some embodiments, the PAM is located on the non-targeted strand of the target region, i.e., the strand that is complementary to the target nucleic acid. In some embodiments, the targeting sequence of the gRNA is complementary to a target nucleic acid sequence one nucleotide from an ATC PAM sequence. In some embodiments, the targeting sequence of the gRNA is complementary to a target nucleic acid sequence one nucleotide from an CTC PAM sequence. In some embodiments, the targeting sequence of the gRNA is complementary to a target nucleic acid sequence one nucleotide from an GTC PAM sequence. In some embodiments, the targeting sequence of the gRNA is complementary to a target nucleic acid sequence one nucleotide from an TTC PAM sequence. By selection of the targeting sequences of the gRNA, defined regions of the target nucleic acid sequence or sequences bracketing a particular location within the target nucleic acid can be repressed using the repressor fusion protein:gRNA systems described herein. In some embodiments, the targeting sequence of the gRNA has between 15 and 20 consecutive nucleotides. In some embodiments, the targeting sequence has 15, 16, 17, 18, 19, and 20 consecutive nucleotides. In some embodiments, the targeting sequence consists of 20 consecutive nucleotides. In some embodiments, the targeting sequence consists of 19 consecutive nucleotides. In some embodiments, the targeting sequence consists of 18 consecutive nucleotides. In some embodiments, the targeting sequence consists of 17 consecutive nucleotides. In some embodiments, the targeting sequence consists of 16 consecutive nucleotides. In some embodiments, the targeting sequence consists of 15 consecutive nucleotides. By selection of the targeting sequences of the gRNA, defined regions of the target nucleic acid sequence can be repressed and/or epigenetically modified using the repressor fusion protein:gRNA systems described herein.

The gene repressor systems of the present disclosure can be designed to target any region of, or proximal to, a PCSK9 gene or region of a PCSK9 gene for which repression of transcription is sought. When the entirety of the gene is to be repressed, designing a guide with a targeting sequence complementary to a sequence encompassing or proximal to the transcription start site (TSS) is contemplated by the disclosure. The TSS selection occurs at different positions within the promoter region, depending on promoter sequence and initiating-substrate concentration. The core promoter serves as a binding platform for the transcription machinery, which comprises Pol II and its associated general transcription factors (GTFs) (Haberle, V. et al. Eukaryotic core promoters and the functional basis of transcription initiation (Nat Rev Mol Cell Biol. 19(10): 621 (2018)). Variability in TSS selection has been proposed to involve DNA 'scrunching' and 'anti-scrunching,' the hallmarks of which are: (i) forward and reverse movement of the RNA polymerase leading edge, but not trailing edge, relative to DNA, and (ii) expansion and contraction of the transcription bubble. In some embodiments, the target nucleic acid sequence bound by an RNP of the repressor fusion protein: gRNA system is within 1 kb of a transcription start site (TSS) in the PCSK9 gene. In some embodiments, the target nucleic acid sequence bound by an RNP of the system is within 20 bp, 50 bp, 100 bp, 150 bp, 200 bp, 250 bp, 500 bps, 1 kb, or 1.5 kb upstream of a TSS of the PCSK9 gene. In some embodiments, the target nucleic acid sequence bound by an RNP of the system is within 20 bp, 50 bp, 100 bp, 150 bp, 200 bp, 250 bp, 500 bps, 1 kb, or 1.5 kb downstream of a TSS of the PCSK9 gene. In some embodiments, the target nucleic acid sequence bound by an RNP of the system is within 1.5 kb upstream to 1.5 downstream, 1 kb upstream to 1 kb downstream, 500 bps upstream to 500 bps downstream, or 300 bps upstream to 300 bps downstream, or 100 bps upstream to 100 bps downstream of a TSS of the PCSK9 gene. In some embodiments, the target nucleic acid sequence bound by an RNP of the system is within 20 bp, 50 bp, 100 bp, 150 bp, 200 bp, 250 bp, 500 bps, 1 kb, or 1.5 kb of an enhancer of the PCSK9 gene. In some embodiments, the target nucleic acid sequence bound by an RNP of the system of the disclosure is within 1 kb 3' to a 5' untranslated region of the PCSK9 gene. In other embodiments, the target nucleic acid sequence bound by an RNP of the system is within the open reading frame of the PCSK9 gene, inclusive of introns (if any). In some embodiments, the targeting sequence of a gRNA of the system of the disclosure is designed to be specific for an exon of the PCSK9 gene. In a particular embodiment, the targeting sequence of a gRNA of the system of the disclosure is designed to be specific for exon 1 of the PCSK9 gene. In other embodiments, the targeting sequence of a gRNA of the system of the disclosure is designed to be specific for an intron of the PCSK9 gene. In other embodiments, the targeting sequence of the gRNA of the system of the disclosure is designed to be specific for an intron-exon junction of the PCSK9 gene. In other embodiments, the targeting sequence of the gRNA of the system of the disclosure is designed to be specific for a regulatory element of the PCSK9 gene. In other embodiments, the targeting sequence of the gRNA of the system of the disclosure is designed to be complementary to a sequence of an intergenic region of the PCSK9 gene. In other embodiments, the targeting sequence of a gRNA of the system of the disclosure is specific for a junction of the exon, an intron, and/or a regulatory element of the PCSK9 gene. In those cases where the targeting sequence is specific for a regulatory element, such regulatory elements include, but are not limited to promoter regions, enhancer regions, intergenic regions, 5' untranslated regions (5' UTR), 3' untranslated regions (3' UTR), conserved elements, and regions comprising cis-regulatory elements. The promoter region is intended to encompass nucleotides within 5 kb of the initiation point of the encoding sequence or, in the case of gene enhancer elements or conserved elements, can be thousands of bp, hundreds of thousands of bp, or even millions of bp away from the encoding sequence of the PCSK9 gene. In the foregoing, the targets are those in which the encoding PCSK9 gene of the target is intended to be repressed such that the PCSK9 gene product is not expressed or is expressed at a lower level in a cell. In some embodiments, upon binding of the RNP of the system of the disclosure to the binding location of the target nucleic acid, the system is capable of repressing transcription of the PCSK9 gene 5' to the binding location of the RNP. In other embodiments, upon binding of the RNP of the system to the binding location of the target nucleic acid, the system is capable of repressing transcription of the PCSK9 gene 3' to the binding location of the RNP.

In some embodiments, the target nucleic acid comprises a PAM sequence located 5' of the targeting sequence with at least a single nucleotide separating the PAM from the first nucleotide of the targeting sequence. In some embodiments, the PAM is located on the non-targeted strand of the target region, i.e. the strand that is complementary to the target nucleic acid. Representative, but non-limiting examples of targeting sequences to wild-type PCSK9 nucleic acid are presented as SEQ ID NOS: 1824-2944, and are shown below as Table 7, representing targeting sequences for PCSK9 target nucleic acid for linkage to the gRNA scaffolds of the disclosure; e.g., gRNA 174, 235, 316, or chemically-modified versions thereof. In some embodiments, the targeting sequence of the gRNA comprises a sequence having at least about 65%, at least about 75%, at least about 85%, or at least about 95% identity to a sequence selected from the group consisting of SEQ ID NOS: 1824-2944. In some embodiments, the PAM sequence is TTC. In some embodiments, a targeting sequences for a TTC PAM comprises SEQ ID NOS: 1824-2944, or a sequence that is at least 50% identical, at least 55% identical, at least 60% identical, at least 65% identical, at least 70% identical, at least 75% identical, at least 80% identical, at least 85% identical, at least 90% identical, at least 95% identical, or at least 99% identical to SEQ ID NOS: 1824-2944. In some embodiments, a targeting sequence for a TTC PAM is selected from the group consisting of SEQ ID NOS: 1824-2944.

In some embodiments, the targeting sequence of the gRNA for use in the repressor fusion protein:gRNA systems of the disclosure comprises a sequence selected from the group consisting of SEQ ID NO: 1824-2545. In a particular embodiment, the targeting sequence of the gRNA for use in the repressor fusion protein:gRNA systems of the disclosure consists of a sequence selected from the group consisting of SEQ ID NOS: 1824-1890, 1910, 1925, 2672, 2675, 2694, and 2714. In some embodiments, the targeting sequence consists of SEQ ID NO: 1834. In some embodiments, the targeting sequence consists of SEQ ID NO: 2009. In some embodiments, the targeting sequence consists of SEQ ID NO: 2341. In some embodiments, the targeting sequence consists of SEQ ID NO: 1841. In some embodiments, the targeting sequence consists of SEQ ID NO: 1842. In some embodiments, the targeting sequence consists of SEQ ID NO: 1844. In some embodiments, the targeting sequence consists of SEQ ID NO: 1845. In some embodiments, the targeting sequence consists of SEQ ID NO: 2672. In some embodiments, the targeting sequence consists of SEQ ID NO: 1884. In some embodiments, the targeting sequence consists of SEQ ID NO: 1851. In some embodiments, the targeting sequence consists of SEQ ID NO: 1849. In some embodiments, the targeting sequence consists of SEQ ID NO: 1852. In some embodiments, the targeting sequence consists of SEQ ID NO: 1853. In some embodiments, the targeting sequence consists of SEQ ID NO: 1855. In some embodiments, the targeting sequence consists of SEQ ID NO: 1856. In some embodiments, the targeting sequence consists of SEQ ID NO: 1857. In some embodiments, the targeting sequence consists of SEQ ID NO: 1858. In some embodiments, the targeting sequence consists of SEQ ID NO: 1859. In some embodiments, the targeting sequence consists of SEQ ID NO: 1860. In some embodiments, the targeting sequence consists of SEQ ID NO: 1862. In some embodiments, the targeting sequence consists of SEQ ID NO: 1863. In some embodiments, the targeting sequence consists of SEQ ID NO: 1867. In some embodiments, the targeting sequence consists of SEQ ID NO: 1869. In some embodiments, the targeting sequence consists of SEQ ID NO: 1870. In some embodiments, the targeting sequence consists of SEQ ID NO: 1872. In some embodiments, the targeting sequence consists of SEQ ID NO: 1875. In some embodiments, the targeting sequence consists of SEQ ID NO: 1830. In any of the foregoing, the targeting sequence may have 1, 2, 3, 4, or 5 nucleotides removed from the 3' end of the targeting sequence.

TABLE 7

Targeting Sequences Specific to PCSK9

| SEQ ID NO: | PAM Sequence |
|---|---|
| 1824-2944 | TTC |

TABLE 8

Exemplary Targeting Sequences of PCSK9

| SEQ ID NO: | PAM Sequence |
|---|---|
| 1824-1890, 1910, 1925, 2672, 2675, 2694, and 2714 | TTC |

c. gRNA Modifications

In another aspect, the disclosure relates to gRNAs (sometimes referred to as gRNA variants herein) which comprise modifications relative to a reference gRNA from which the gRNAs were derived. The gRNAs can be used in the systems of the disclosure. In some embodiments, a gRNA variant comprises one or more nucleotide substitutions, insertions, deletions, or swapped or replaced domains relative to a reference gRNA sequence that improve a characteristic relative to the reference gRNA. Exemplary regions for modifications and swapped regions or domains include the RNA triplex, the pseudoknot, the scaffold stem loop, and the extended stem loop. In some embodiments, the gRNA variant comprises at least a first swapped region from a different gRNA, resulting in a chimeric gRNA. A representative example of such a chimeric gRNA is guide 316 (SEQ ID NO: 1746), in which the extended stem loop of gRNA scaffold 235 is replaced with the extended stem loop of gRNA scaffold 174, wherein the resulting 316 variant retains the ability to form an RNP with an repressor fusion protein and exhibits an improved characteristic compared to the parent 235, when assessed in an in vitro or in vivo assay under comparable conditions.

All gRNAs that have one or more improved functions, characteristics, or add one or more new functions when the gRNA scaffold variant is compared to a gRNA scaffold from which it was derived, while retaining the functional properties of being able to complex with the repressor fusion protein and guide the ribonucleoprotein holo RNP complex to the target nucleic acid are envisaged as within the scope of the disclosure. In some embodiments, the gRNA has an improved characteristic selected from the group consisting of increased pseudoknot stem stability, increased triplex region stability, increased scaffold stem stability, extended stem stability, reduced off-target folding intermediates, increased binding affinity to a repressor fusion protein, and increased repression activity when complexed with a repressor fusion protein, or any combination thereof. In some cases of the foregoing, the improved characteristic is assessed in an in vitro assay, including the assays of the Examples. In other cases of the foregoing, the improved characteristic is assessed in vivo.

Table 9 provides exemplary gRNA variant scaffold sequences for the generation of the gRNAs. The gRNAs can be used in the repressor fusion protein:gRNA systems of the disclosure. In some embodiments, the gRNA variant scaffold comprises any one of the sequences listed in Table 9, or a sequence having at least about 50%, at least about 60%, at least about 70%, at least about 80%, at least about 90%, at least about 95%, at least about 95%, at least about 96%, at least about 97%, at least about 98%, at least about 99% sequence identity thereto, wherein the gRNA variant retains the ability to form an RNP with a dCasX of the disclosure. In other embodiments, the gRNA variant scaffold comprises any one of the sequences listed in Table 9, wherein the gRNA variant retains the ability to form an RNP with an repressor fusion protein of the disclosure. It will be understood that in those embodiments wherein a vector comprises a DNA encoding sequence for a gRNA, that thymine (T) bases can be substituted for the uracil (U) bases of any of the gRNA sequence embodiments described herein. In some embodiments, the disclosure provides gRNA variants of Table 9 that are chemically-modified, described below.

d. gRNA Scaffold 316

Guide scaffolds can be made by several methods, including recombinantly or by solid-phase RNA synthesis. However, the length of the scaffold can affect the manufacturability when using solid-phase RNA synthesis, with longer lengths resulting in increased manufacturing costs, decreased purity and yield, and higher rates of synthesis failure. For use in particle formulations, such as lipid nanoparticle (LNP) formulations, solid-phase RNA synthesis of the scaffold is preferred to generate the quantities needed for commercial development. While previous experiments had identified gRNA scaffold 235 as having enhanced properties relative to gRNA scaffold 174, its increased length (in nucleotides) rendered its use for LNP formulations problematic due to synthetic manufacturing constraints. Accordingly, alternative sequences were sought. In some embodiments, the disclosure provides gRNA variant scaffolds having improved manufacturability compared to the gRNA scaffold from which it was derived. In some embodiments, the disclosure provides a gRNA wherein the gRNA scaffold and linked targeting sequence has a sequence that is less than about 115 nucleotides, less than about 110 nucleotides, or less than about 100 nucleotides.

In some embodiments, a gRNA scaffold was designed wherein the scaffold 174 (SEQ ID NO: 1744) sequence was modified by introducing one or more mutations at positions selected from the group consisting of U11, U24, A29, and A87. In some embodiments, the gRNA comprises a sequence of SEQ ID NO: 1744, or a sequence having at least about 70% sequence identity thereto, comprising an extended stem loop sequence of SEQ ID NO: 49739 and one or more mutations at positions selected from the group consisting of U11, U24, A29, and A87. In one embodiment of the foregoing, the mutations consist of U11C, U24C, A29C, and A87G, resulting in the sequence of SEQ ID NO: 1746.

In another embodiment, the 316 gRNA scaffold was designed wherein the scaffold 235 sequence was modified by a domain swap in which the extended stem loop of scaffold 174 replaced the extended stem loop of the 235 scaffold, resulting in the chimeric gRNA scaffold 316 (SEQ ID NO: 1746), having 89 nucleotides, compared with the 99 nucleotides of gRNA scaffold 235. The resulting 316 scaffold had the further advantage in that the extended stem loop does not contain CpG motifs; an enhanced property conferring reduced potential to elicit an immune response. In some

TABLE 9 gRNA Scaffold Sequences

| SEQ ID NO: | Scaffold variant ID | Nucleotide sequence |
|---|---|---|
| 1744 | 174 | ACUGGCGCUUUUAUCUGAUUACUUUGAGAGCCAUCACCAGCGACUAU GUCGUAGUGGGUAAAGCUCCCUCUUCGGAGGGAGCAUCAAAG |
| 1745 | 235 | ACUGGCGCUUCUAUCUGAUUACUCUGAGCGCCAUCACCAGCGACUAU GUCGUAGUGGGUAAAGCCGCUUACGGACUUCGGUCCGUAAGAGGCAU CAGAG |
| 1746 | 316 | ACUGGCGCUUCUAUCUGAUUACUCUGAGCGCCAUCACCAGCGACUAU GUCGUAGUGGGUAAAGCUCCCUCUUCGGAGGGAGCAUCAGAG |

Additional gRNA scaffold variants contemplated for use in the gRNAs, and in the repressor fusion protein:gRNA systems of the disclosure are selected from the group consisting of SEQ ID NOS: 1747-1821.

embodiments, the shorter sequence length of the 316 scaffold confers the improvements of a higher fidelity in the ability to create the guide synthetically with the correct and complete sequence, as well as an enhanced ability to be successfully incorporated into an LNP. In some embodiments, the disclosure provides gRNA 316 variants that are chemically-modified, described below.

e. Chemically-Modified gRNAs

Figure 19A:
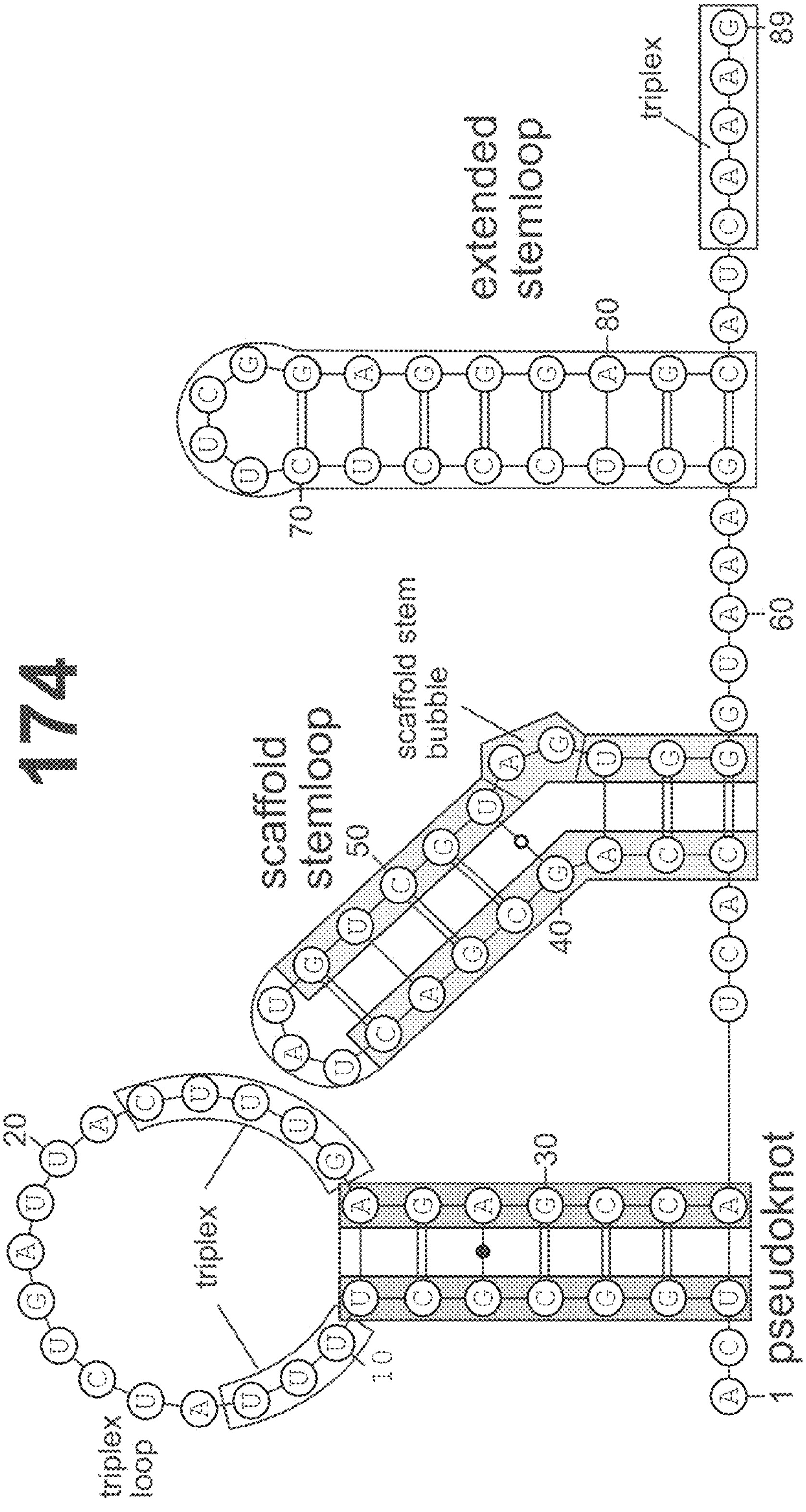
FIG. 19A is a schematic of gRNA scaffold variant 174 (SEQ ID NO: 1744), as described in Example 7. Structural motifs are highlighted.
Figure 19B:
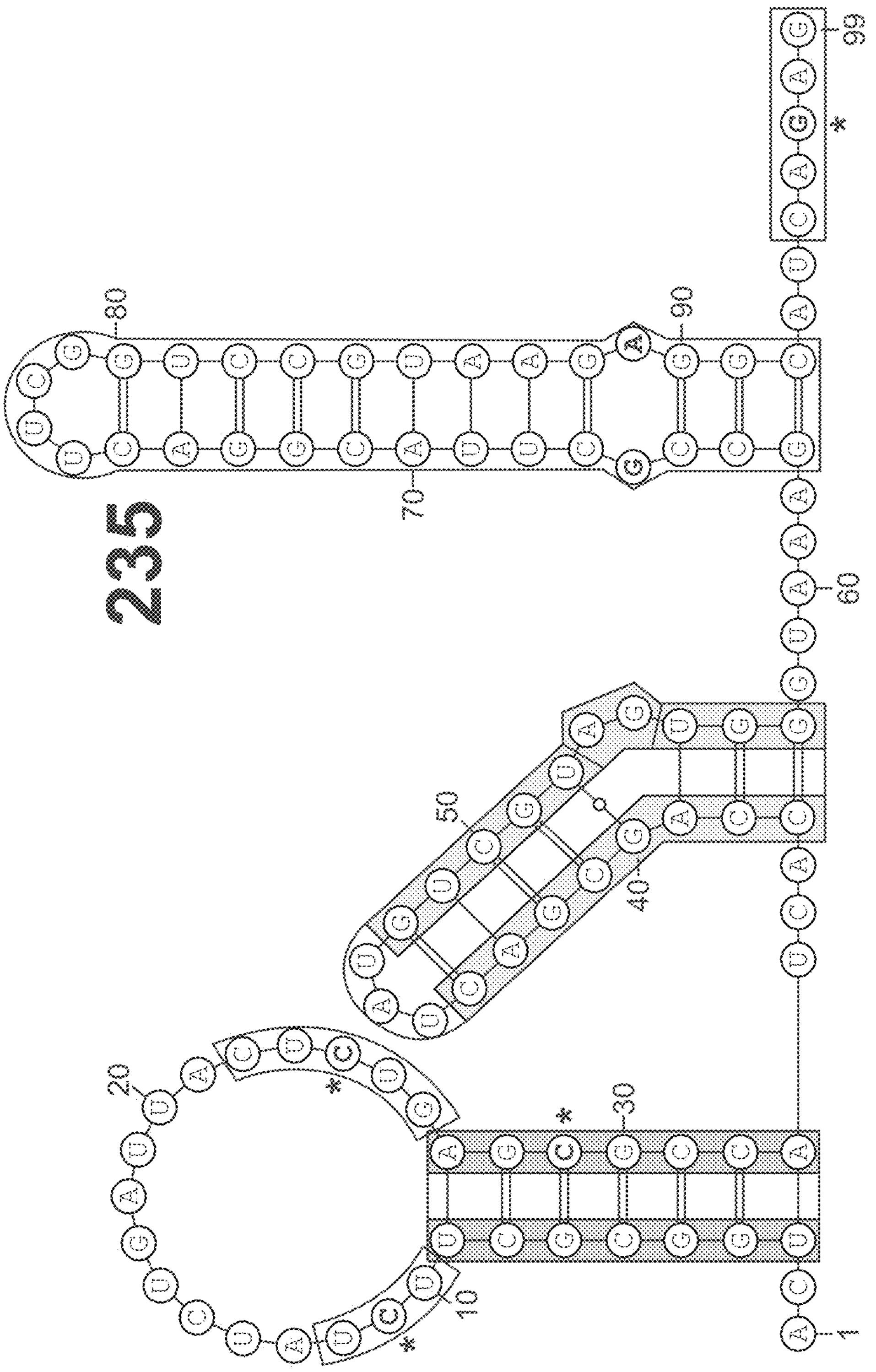
FIG. 19B is a schematic of gRNA scaffold variant 235 (SEQ ID NO: 1745), as described in Example 7. Highlighted structural motifs are the same as in FIG. 19A. The differences between variant 174 and variant 235 lie in the extended stem motif and several single-nucleotide changes (indicated with asterisks). Variant 316 maintains the shorter extended stem from variant 174 but harbors the four substitutions found in scaffold 235.
Figure 19C:
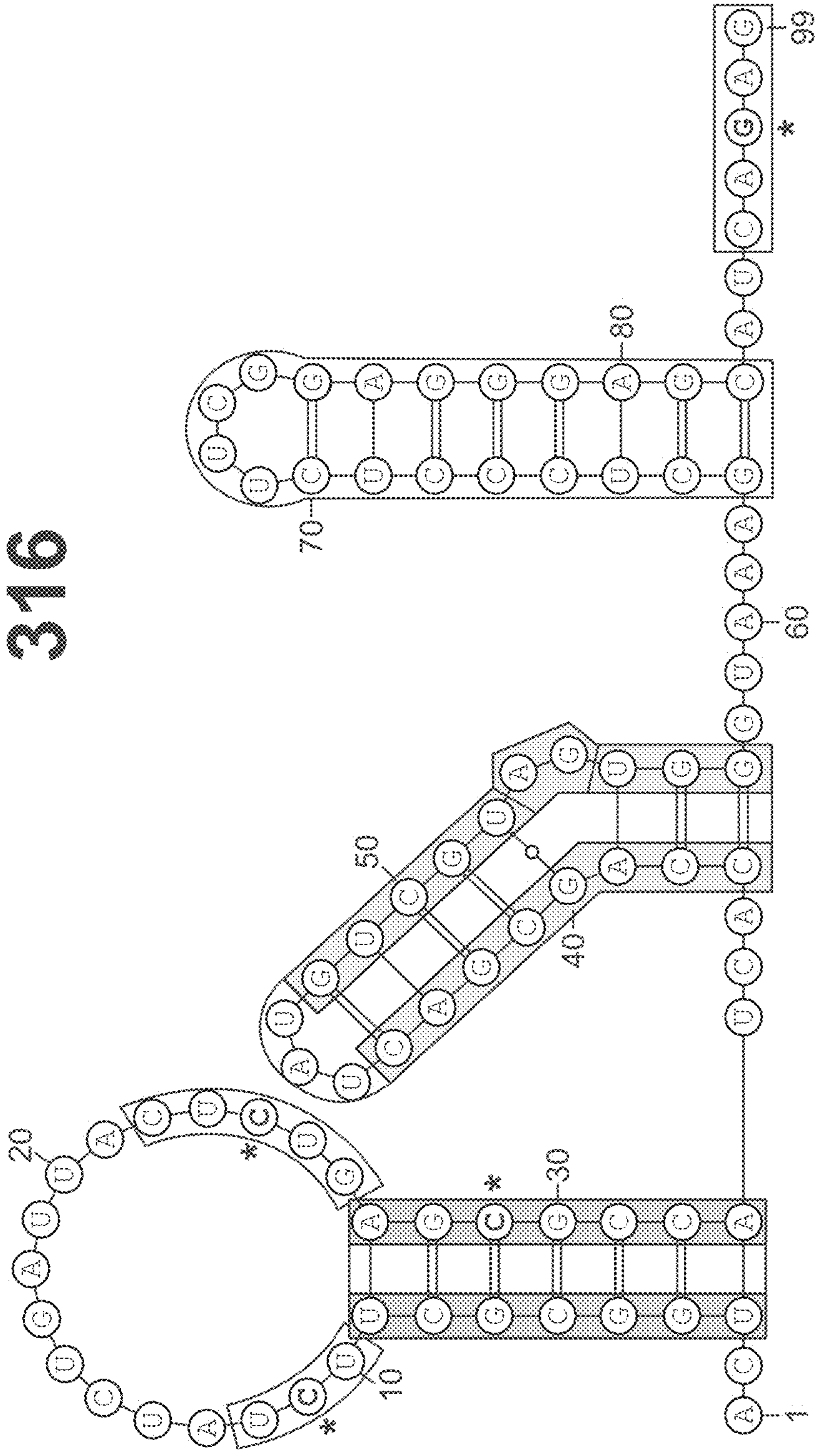
FIG. 19C is a schematic of gRNA scaffold variant 316 (SEQ ID NO: 1746), as described in Example 7. Highlighted structural motifs are the same as in FIG. 19A. Variant 316 maintains the shorter extended stem from variant 174 (FIG. 19A) but harbors the four substitutions found in scaffold 235 (FIG. 19B).

In some embodiments, the gRNAs have one or more chemical modifications. In some embodiments, the chemical modification is the addition of a 2'O-methyl group to one or more nucleotides of the sequence. In some embodiments, the chemical modification is substitution of a phosphorothioate bond between two or more nucleosides of the sequence. In some embodiments, the first 1, 2, or 3 nucleosides of the 5' end of the scaffold (i.e., A, C, and U in the case of gRNA 174, 235, and 316) are modified by the addition of a 2'O-methyl group and each of the modified nucleosides is linked to the adjoining nucleoside by a phosphorothioate bond. Similarly, the last 1, 2, or 3 nucleotides of the 3' end of the targeting sequence linked to the 3' end of the scaffold are similarly modified. In some embodiments, the disclosure provides gRNA with chemical modifications selected from the group consisting of the sequences of SEQ ID NOS: 2948-2956, 2958-2966, and 2968-2976, as set forth in Table 25, or a sequence having at least about 70%, at least about 80%, at least about 90%, at least about 95%, at least about 96%, at least about 97%, at least about 98%, at least about 99% sequence identity thereto. In some embodiments, the gRNA with chemical modifications comprises a scaffold of SEQ ID NOS: 2948-2956, 2958-2966, and 2968-2976, i.e., a sequence of SEQ ID NOS: 2948-2956, 2958-2966, and 2968-2976 without the spacer represented in the foregoing sequences as undefined nucleotides. The skilled artisan will understand the 20 3' terminal undefined sequences in the foregoing represent non-targeting sequences, and can be substituted with any suitable targeting sequence complementary to a target nucleic acid of the PCSK9 gene; for example a targeting sequence selected from the group consisting of SEQ ID NOS: 1824-2944. In some embodiments, the chemically modified gRNA comprises the sequence of SEQ ID NO: 2968. A schematic of the structure of gRNA variants 174, 235, and 316 are shown in FIGS. 19A-19C, respectively. In some embodiments, the gRNA with chemical modifications exhibit improved stability compared to gRNA without chemical modifications.

f. Complex Formation with Repressor Fusion Proteins

Upon delivery or expression of the components of the system in a target cell, the gRNA variant is capable of complexing as an RNP with a repressor fusion protein comprising a catalytically-dead CRISPR protein and binding to the target nucleic acid of the PCSK9 gene. In some embodiments, a gRNA variant has an improved ability to form an RNP complex with a repressor fusion protein when compared to a reference gRNA or another gRNA variant from which it was derived. Improving ribonucleoprotein complex formation may, in some embodiments, improve the efficiency with which functional RNPs are assembled. In some embodiments, greater than 90%, greater than 93%, greater than 95%, greater than 96%, greater than 97%, greater than 98% or greater than 99% of RNPs comprising a gRNA variant and its targeting sequence are competent for gene repression of a target nucleic acid.

VI. Polynucleotides and Vectors

In another aspect, the present disclosure relates to polynucleotides encoding the repressor fusion proteins, and, in some embodiments, gRNAs, that have utility in the repression and epigenetic modification of the PCSK9 gene.

A repressor fusion protein or an mRNA encoding the repressor fusion protein of the disclosure may be prepared by in vitro synthesis, using conventional methods as known in the art. Various commercial synthetic apparatuses are available, for example, automated synthesizers by Applied Biosystems, Inc., Beckman, etc. By using synthesizers, naturally occurring amino acids or nucleotides (as applicable) may be substituted with unnatural amino acids or nucleotides. The particular sequence and the manner of preparation will be determined by convenience, economics, purity required, and the like. A gRNA can also be produced synthetically; for example by use of a T7 RNA polymerase system known in the art.

The repressor fusion protein and/or the gRNA may also be prepared by recombinantly producing a polynucleotide sequence coding for the repressor or gRNA of any of the embodiments described herein using standard recombinant techniques known in the art and incorporating the encoding gene into an expression vector appropriate for a host cell. For production of the encoded repressor fusion protein and/or gRNA, the methods include transforming an appropriate host cell with an expression vector comprising the encoding polynucleotide, and culturing the host cell under conditions causing or permitting the resulting repressor or gRNA to be expressed or transcribed in the transformed host cell, which are recovered by methods described herein or by standard purification methods known in the art, or as described in the Examples. Standard recombinant techniques in molecular biology are used to make the polynucleotides and expression vectors of the present disclosure.

A repressor fusion protein and/or a gRNA of the disclosure may also be isolated and purified in accordance with conventional methods of recombinant synthesis. A lysate may be prepared of the expression host and the lysate purified using high performance liquid chromatography (HPLC), exclusion chromatography, gel electrophoresis, affinity chromatography, or other purification technique. For the most part, the compositions which are used will comprise 50% or more by weight of the desired product, more usually 75% or more by weight, preferably 95% or more by weight, and for therapeutic purposes, usually 99.5% or more by weight, in relation to contaminants related to the method of preparation of the product and its purification. Usually, the percentages will be based upon total protein. Thus, in some cases, a repressor fusion protein or gRNA of the present disclosure is at least 80% pure, at least 85% pure, at least 90% pure, at least 95% pure, at least 98% pure, or at least 99% pure (e.g., free of contaminants or other macromolecules, etc.).

Additionally, the disclosure provides vectors comprising polynucleotides encoding the repressor fusion proteins and, in some cases, the gRNAs described herein. In some cases, the vectors are utilized for the expression and recovery of the CasX and gRNA components of the repressor fusion protein: gRNA system. In other cases, the vectors are utilized for the delivery of the encoding polynucleotides to target cells for the repression and/or epigenetic modification of the target nucleic acid, as described more fully, below. In some embodiments, sequences encoding the repressor fusion protein and the gRNA are encoded by the same vector. In some embodiments, sequences encoding the repressor fusion protein and a gRNA are encoded by sequences on different vectors. Suitable vectors are described, for example, in WO2022120095A1 and WO2020247882A1, incorporated by reference herein. As described in WO2022120095A1 and WO2020247882A1, depending on the host/vector system utilized, any of a number of suitable transcription and translation control elements, including constitutive and inducible promoters, transcription enhancer elements, transcription terminators, etc. may be used in the expression vector.

In some embodiments, the disclosure provides polynucleotide sequences encoding repressor fusion proteins, including the repressor fusion proteins of SEQ ID NOS: 3131-3132 as set forth in Table 20, or sequences having at least about 50%, at least about 60%, at least about 70%, at least about 80%, at least about 90%, at least about 95%, at least about 96%, at least about 97%, at least about 98%, or at least about 99% sequence identity thereto. In some embodiments, the disclosure provides an isolated polynucleotide sequence encoding a gRNA variant. In some embodiments, the disclosure provides polynucleotides encoding a gRNA comprising a scaffold sequence of SEQ ID NOS: 1744-1746 and 2947-2976, or a sequence having at least about 50%, at least about 60%, at least about 70%, at least about 80%, at least about 90%, at least about 95%, at least about 96%, at least about 97%, at least about 98%, at least about 99% sequence identity thereto, wherein the expressed gRNA variant retains the ability to form an RNP with an repressor fusion protein. In some embodiments, the disclosure provides polynucleotide sequences encoding gRNAs comprising targeting sequences of SEQ ID NOS: 1824-2944, or sequences having at least about 65%, at least about 75%, at least about 85%, or at least about 95% identity thereto. In some embodiments, the disclosure provides polynucleotide sequences encoding gRNAs comprising targeting sequences of SEQ ID NOS: 1824-1890, 1910, 1925, 2672, 2675, 2694, and 2714, or sequences having at least about 65%, at least about 75%, at least about 85%, or at least about 95% identity thereto.

In some embodiments, the disclosure relates to methods to produce polynucleotide sequences encoding the repressor fusion proteins or the gRNAs, including variants thereof, as well as methods to express the proteins or RNA transcribed by the polynucleotide sequences. In general, the methods include producing a polynucleotide sequence coding for the repressor fusion protein or the gRNA of any of the embodiments described herein and incorporating the encoding gene into an expression vector. In some embodiments, the vector is designed for transduction of cells for repression and/or epigenetic modification of the PCSK9 target nucleic acid. Such vectors can include a retroviral vector, a lentiviral vector, an adenoviral vector, an adeno-associated viral (AAV) vector, a herpes simplex virus (HSV) vector, a plasmid, a minicircle, a nanoplasmid, a DNA vector, and an RNA vector. In other embodiments, the expression vector is designed for production of a repressor fusion protein, mRNA encoding the repressor fusion protein, or gRNA in either a cell-free system or in a host cell. For production of the encoded repressor fusion protein or the gRNA of any of the embodiments described herein in a host cell, the methods include transforming an appropriate host cell with an expression vector comprising the encoding polynucleotide, and culturing the host cell under conditions causing or permitting the resulting repressor fusion protein or the gRNA of any of the embodiments described herein to be expressed or transcribed in the transformed host cell, thereby producing the repressor fusion protein or the gRNA, which are recovered by methods described herein (e.g., in the Examples, below) or by standard purification methods known in the art. Standard recombinant techniques in molecular biology are used to make the polynucleotides and expression vectors of the present disclosure.

In accordance with the disclosure, nucleic acid sequences that encode the repressor fusion protein or the gRNA of any of the embodiments described herein are used to generate recombinant DNA molecules that direct the expression in appropriate host cells. Several cloning strategies are suitable for performing the present disclosure, many of which are used to generate a construct that comprises a gene coding for a composition of the present disclosure, or its complement. In some embodiments, the cloning strategy is used to create a gene that encodes a construct that comprises nucleotides encoding the repressor fusion protein or the gRNA that is used to transform a host cell for expression of the composition.

In one approach, a construct is first prepared containing the DNA sequence encoding a repressor fusion protein or a gRNA. Exemplary methods for the preparation of such constructs are described in the Examples. The construct is then used to create an expression vector suitable for transforming a host cell, such as a prokaryotic or eukaryotic host cell for the expression and recovery of the protein construct, in the case of the repressor fusion protein, or the gRNA. Where desired, the host cell is an *E. coli*. In other embodiments, the host cell is a eukaryotic cell. The eukaryotic host cell can be selected from Baby Hamster Kidney fibroblast (BHK) cells, human embryonic kidney 293 (HEK293), human embryonic kidney 293T (HEK293T), NS0 cells, SP2/0 cells, YO myeloma cells, P3X63 mouse myeloma cells, PER cells, PER.C6® cells, hybridoma cells, NIH3T3 cells, CV-1 (simian) in Origin with SV40 genetic material (COS), HeLa, Chinese hamster ovary (CHO), yeast cells, or other eukaryotic cells known in the art suitable for the production of recombinant products. Exemplary methods for the creation of expression vectors, the transformation of host cells and the expression and recovery of the repressor fusion protein or the gRNA are described in the Examples.

The gene encoding the repressor fusion protein or the gRNA construct can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate sequences of polynucleotides encoding the various components into a gene of a desired sequence. Genes encoding polypeptide compositions are assembled from oligonucleotides using standard techniques of gene synthesis.

In some embodiments, the nucleotide sequence encoding an repressor fusion protein is codon optimized. This type of optimization can entail a mutation of an encoding nucleotide sequence to mimic the codon preferences of the intended host organism or cell while encoding the same protein. Thus, the codons can be changed, but the encoded protein remains unchanged. For example, if the intended target cell of the repressor fusion protein was a human cell, a human codon-optimized repressor fusion protein-encoding nucleotide sequence could be used. As another non-limiting example, if the intended host cell were a mouse cell, then a mouse codon-optimized repressor fusion protein-encoding nucleotide sequence could be generated. The gene design can be performed using algorithms that optimize codon usage and amino acid composition appropriate for the host cell utilized in the production of the repressor fusion protein or the gRNA. In one method of the disclosure, a library of polynucleotides encoding the components of the constructs is created and then assembled, as described above. The resulting genes are then assembled and the resulting genes used to transform a host cell and produce and recover the repressor fusion protein or the gRNA compositions for evaluation of its properties or for use in the modification of the PCSK9 target nucleic acid, as described herein.

In some embodiments, a nucleotide sequence encoding a gRNA is operably linked to a control element, e.g., a transcriptional control element, such as a promoter. In some embodiments, a nucleotide sequence encoding a repressor fusion protein is operably linked to a control element, e.g., a transcriptional control element, such as a promoter. In some cases, the promoter is a constitutively active promoter. In some cases, the promoter is a regulatable promoter. In some cases, the promoter is an inducible promoter. In some cases, the promoter is a tissue-specific promoter. In some cases, the promoter is a cell type-specific promoter. In some cases, the transcriptional control element (e.g., the promoter) is functional in a targeted cell type or targeted cell population. For example, in some cases, the transcriptional control element can be functional in eukaryotic cells, e.g., hepatocytes or a liver sinusoidal endothelial cell.

Non-limiting examples of Pol II promoters operably linked to the polynucleotide encoding the repressor fusion protein of the disclosure include, but are not limited to EF-1alpha, EF-1alpha core promoter, Jens Tornoc (JeT), promoters from cytomegalovirus (CMV), CMV immediate early (CMVIE), CMV enhancer, herpes simplex virus (HSV) thymidine kinase, early and late simian virus 40 (SV40), the SV40 enhancer, long terminal repeats (LTRs) from retrovirus, mouse metallothionein-I, adenovirus major late promoter (Ad MLP), CMV promoter full-length promoter, the minimal CMV promoter, the chicken β-actin promoter (CBA), CBA hybrid (CBh), chicken β-actin promoter with cytomegalovirus enhancer (CB7), chicken beta-Actin promoter and rabbit beta-Globin splice acceptor site fusion (CAG), the rous sarcoma virus (RSV) promoter, the HIV-Ltr promoter, the hPGK promoter, the HSV TK promoter, a 7SK promoter, the Mini-TK promoter, the human synapsin I (SYN) promoter which confers neuron-specific expression, beta-actin promoter, super core promoter 1 (SCP1), the Mecp2 promoter for selective expression in neurons, the minimal IL-2 promoter, the Rous sarcoma virus enhancer/promoter (single), the spleen focus-forming virus long terminal repeat (LTR) promoter, the TBG promoter, promoter from the human thyroxine-binding globulin gene (Liver specific), the PGK promoter, the human ubiquitin C promoter (UBC), the UCOE promoter (Promoter of HNRPA2B1-CBX3), the synthetic CAG promoter, the Histone H2 promoter, the Histone H3 promoter, the U1a1 small nuclear RNA promoter (226 nt), the U1a1 small nuclear RNA promoter (226 nt), the U1b2 small nuclear RNA promoter (246 nt) 26, the GUSB promoter, the CBh promoter, rhodopsin (Rho) promoter, silencing-prone spleen focus forming virus (SFFV) promoter, a human H1 promoter (H1), a POLI promoter, the TTR minimal enhancer/promoter, the b-kinesin promoter, mouse mammary tumor virus long terminal repeat (LTR) promoter, the human eukaryotic initiation factor 4A (EIF4A1) promoter, the ROSA26 promoter, the glyceraldehyde 3-phosphate dehydrogenase (GAPDH) promoter, tRNA promoters, and truncated versions and sequence variants of the foregoing. In a particular embodiment, the Pol II promoter is EF-1alpha, wherein the promoter enhances transfection efficiency, the transgene transcription or expression of the CRISPR nuclease, the proportion of expression-positive clones and the copy number of the episomal vector in long-term culture.

Non-limiting examples of Pol III promoters operably linked to the polynucleotide encoding the gRNA variants of the disclosure include, but are not limited to U6, mini U6, U6 truncated promoters, 7SK, and H1 variants, BiH1 (Bidirectional H1 promoter), BiU6, Bi7SK, BiH1 (Bidirectional U6, 7SK, and HI promoters), gorilla U6, rhesus U6, human 7SK, human H1 promoters, and truncated versions and sequence variants thereof. In the foregoing embodiment, the pol III promoter enhances the transcription of the gRNA. In a particular embodiment, the Pol III promoter is U6, wherein the promoter enhances expression of the gRNA. In another particular embodiment, the promoter linked to the gene encoding the tropism factor is CMV promoter. Experimental details and data for the use of such promoters are provided in the Examples.

Selection of the appropriate vector and promoter is well within the level of ordinary skill in the art, as it related to controlling expression. The expression vector may also contain a ribosome binding site for translation initiation, and a transcription terminator. The expression vector may also include appropriate sequences for amplifying expression. The expression vector may also include nucleotide sequences encoding protein tags (e.g., 6xHis tag, hemagglutinin tag, fluorescent protein, etc.) that can be fused to the repressor fusion protein, thus resulting in a chimeric protein that are used for purification or detection.

Recombinant expression vectors of the disclosure can also comprise elements that facilitate robust expression of the proteins and the gRNAs of the disclosure. For example, recombinant expression vectors can include one or more of a polyadenylation signal (poly(A)), an intronic sequence or a post-transcriptional regulatory element such as a woodchuck hepatitis post-transcriptional regulatory element (WPRE). Exemplary poly(A) sequences include hGH poly (A) signal (short), HSV TK poly(A) signal, synthetic polyadenylation signals, SV40 poly(A) signal, β-globin poly(A) signal and the like (for example, SEQ ID NO: 3459). A person of ordinary skill in the art will be able to select suitable elements to include in the recombinant expression vectors described herein.

The polynucleotides encoding the repressor fusion protein or the gRNA sequences can be individually cloned into an expression vector. Selection of the appropriate vector and promoter is well within the level of ordinary skill in the art, as it relates to controlling expression, e.g., for repressing expression and/or epigenetic modification of the PCSK9 gene. The expression vector may also contain a ribosome binding site for translation initiation and a transcription terminator. The expression vector may also include appropriate sequences for amplifying expression.

The nucleic acid sequence is inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature. Various vectors are publicly available. The vector may, for example, be in the form of a plasmid, cosmid, viral particle, or phage that may conveniently be subjected to recombinant DNA procedures, and the choice of vector will often depend on the host cell into which it is to be introduced. Thus, the vector may be an autonomously replicating vector, i.e., a vector, which exists as an extrachromosomal entity, the replication of which is independent of chromosomal replication, e.g., a plasmid. Alternatively, the vector may be one which, when introduced into a host cell, is integrated into the host cell genome and replicated together with the chromosome(s) into which it has been integrated. Once introduced into a suitable host cell, expression of the repressor fusion protein can be determined using any nucleic acid or protein assay known in the art. For example, the presence of transcribed mRNA of the repressor fusion protein can be detected and/or quantified by conventional hybridization assays (e.g., Northern blot analysis), amplification procedures (e.g., RT-PCR), SAGE (U.S. Pat. No. 5,695,937), and array-based technologies (see e.g., U.S. Pat. Nos. 5,405,783, 5,412,087 and 5,445,934), using probes complementary to any region of CasX polynucleotide.

In some embodiments, a vector is created for the transcription of the repressor fusion protein gene and expression and recovery of the resulting encoding mRNA. In some embodiments, the mRNA is generated by in vitro transcription (IVT) using a PCR product or linearized plasmid DNA template and a T7 RNA polymerase, wherein the plasmid contains a T7 promoter. If using a PCR product, DNA sequences encoding candidate mRNAs will be cloned into a plasmid containing a T7 promoter, wherein the plasmid DNA template will be linearized and then used to perform IVT reactions for expression of the mRNA. Exemplary methods for the generation of such vectors and the production and recovery of the mRNA are provided in the Examples, below.

VII. Particles for Delivery of Repressor Fusion Proteins

In another aspect, the present disclosure provides particle compositions for delivery of the repressor fusion proteins to cells or to subjects for the modification of the PCSK9 gene. In some embodiments, the particle composition delivers a repressor fusion protein:gRNA system, e.g., when the repressor fusion protein comprises a catalytically dead CRISPR protein such as a dCasX, to cells or to subjects for the repression of the PCSK9 gene. In some embodiments, the disclosure provides synthetic nanoparticles that encapsulate gRNA variants and mRNAs encoding a repressor fusion proteins comprising a dCasX protein of any of the embodiments described herein. In some embodiments, materials for the creation of biodegradable polymeric nanoparticles (PNP) include polylactide, poly (lactic-co-glycolic acid) (PLGA), poly(ethyl cyanoacrylate), poly(butyl cyanoacrylate), poly(isobutyl cyanoacrylate), and poly(isohexyl cyanoacrylate), polyglutamic acid (PGA), poly(ε-caprolactone) (PCL), cyclodextrin, and natural polymers for instance chitosan, albumin, gelatin, and alginate are the most utilized polymers for the synthesis of PNP (Production and clinical development of nanoparticles for gene delivery. Molecular Therapy-Methods & Clinical Development 3:16023; doi:10.1038 (2016)). In some embodiments, the disclosure provides virus-like particles for delivery of the repressor fusion proteins comprising a dCasX protein and gRNA variants (see, WO2021113772A1, incorporated by reference herein). In other embodiments, the disclosure provides lipid nanoparticles that encapsulate gRNA variants and mRNAs encoding repressor fusion proteins comprising a dCasX protein of any of the embodiments described herein, described more fully, below.

a. Lipid Nanoparticles (LNP)

In another aspect, the present disclosure provides lipid nanoparticles (LNP) for delivery of the repressor fusion protein:gRNA systems of the disclosure to cells or to subjects for the transcriptional repression of the PCSK9 gene. In some embodiments, the LNPs of the disclosure are tissue- or organ-specific (e.g., the liver), have excellent biocompatibility, and can deliver the systems with high efficiency, and thus can be usefully used for the repression of the PCSK9 gene.

In their native forms, nucleic acid polymers are unstable in biological fluids and cannot penetrate into the cytoplasm of target cells, thus requiring delivery systems. Lipid nanoparticles (LNP) have proven useful for both the protection and delivery of nucleic acids to tissues and cells. Furthermore, the use of mRNA in LNPs to encode the CRISPR nuclease eliminates the possibility of undesirable genome integration compared to DNA vectors. Moreover, mRNA efficiently translates into protein in both mitotic and non-mitotic cells, as it does not require to enter into the nucleus since it exerts its function in the cytoplasmic compartment. LNPs as a delivery platform offers the additional advantage of being able to co-formulate both the mRNA encoding the nuclease and the gRNA into single LNP particles.

Accordingly, in various embodiments, the disclosure encompasses lipid nanoparticles and compositions that may be used for a variety of purposes, including the delivery of encapsulated or associated (e.g., complexed) therapeutic agents such as nucleic acids to cells, both in vitro and in vivo. In certain embodiments, the disclosure encompasses methods of treating or preventing diseases or disorders in a subject in need thereof by contacting the subject with a lipid nanoparticle that encapsulates or is associated with a suitable therapeutic agent complexed through various physical, chemical or electrostatic interactions between one or more of the lipid components used in the compositions to make LNPs. In some embodiments, the suitable therapeutic agent comprises a repressor fusion protein:gRNA system as described herein.

In certain embodiments, the lipid nanoparticles are useful for the delivery of nucleic acids, including, e.g., the mRNA encoding the repressor fusion proteins of the disclosure, and the gRNA variants of the disclosure, including the sequences of SEQ ID NOS: 1744-1746 and 2947-2976. In some embodiments, the present disclosure provides LNP in which the gRNA and mRNA encoding the repressor fusion proteins are incorporated into single LNP particles. In other embodiments, the present disclosure provides LNP in which the gRNA and mRNA encoding the repressor fusion proteins are incorporated into separate populations of LNPs, which can be formulated together in varying ratios for administration. In some embodiments, the mRNA for incorporation into the LNP of the disclosure encode any of the repressor fusion proteins described herein. In some embodiments, the gRNA for use in the LNP comprises a sequence of SEQ ID NOS: 1744-1746 and 2947-2976.

The lipid nanoparticles and systems of certain embodiments of the disclosure may be used to induce expression of a desired protein both in vitro and in vivo by contacting cells with a lipid nanoparticle comprising one or more novel ionizable cationic lipids or permanently charged cationic lipids described herein, wherein the lipid nanoparticle encapsulates or is associated with a nucleic acid that is expressed to produce the desired protein (e.g., a messenger RNA encoding the CasX protein). In some embodiments, the lipid nanoparticles and systems may be used to decrease the expression of the PCKS9 target gene both in vitro and in vivo by contacting cells with a lipid nanoparticle comprising one or more novel ionizable/cationic lipids described herein, wherein the lipid nanoparticle encapsulates or is associated with nucleic acids of the CasX:gRNA system that reduces target gene expression. The lipid nanoparticles and systems of embodiments of the disclosure may also be used for co-delivery of different nucleic acids (e.g., mRNA, gRNA, siRNA, saRNA, mcDNA and plasmid DNA) separately or in combination, such as may be useful to provide an effect requiring colocalization of different nucleic acids (e.g. mRNA encoding for a suitable gene modifying enzyme and gRNA for targeting of the target nucleic acid).

In some embodiments, LNPs and LNP compositions described herein include at least one cationic lipid, at least one conjugated lipid, at least one steroid or derivative thereof, at least one helper lipid, or any combination thereof. Alternatively, the lipid compositions of the disclosure can include an ionizable lipid, such as an ionizable cationic lipid, a helper lipid (usually a phospholipid), cholesterol, and a polyethylene glycol-lipid conjugate (PEG-lipid) to improve the colloidal stability in biological environments by, for example, reducing a specific absorption of plasma proteins and forming a hydration layer over the nanoparticles. Such lipid compositions can be formulated at typical mole ratios of 50:10:37-39:1-3 or 20-50:8-65:15-70:1-3.0 of IL:HL: Sterol: PEG-lipid, with variations made to include or exclude one or more of the components to the traditional 4-component system in the LNP and to adjust individual properties.

The LNPs and LNP compositions of the present disclosure are configured to protect and deliver an encapsulated payload of the systems of the disclosure to tissues and cells, both in vitro and in vivo. Various embodiments of the LNPs and LNP compositions of the present disclosure are described in further detail herein.

Cationic Lipid

In some embodiments, the LNPs and LNP compositions of the present disclosure include at least one cationic lipid. The term "cationic lipid," refers to a lipid species that has a net positive charge. In some embodiments, the cationic lipid is an ionizable cationic lipid that has a net positive charge at a selected pH<pKa of the ionizable lipid. In some embodiments, the ionizable cationic lipid has a pKa less than about 7 such that the LNPs and LNP compositions achieve efficient encapsulation of the payload at a relatively low pH below the pKa of the respective lipid. In some embodiments, the cationic lipid has a pKa of about 5 to about 8, about 5.5 to about 7.5, about 6 to about 7, or about 6.5 to about 7. In some embodiments, the cationic lipid may be protonated at a pH below the pKa of the cationic lipid, and it may be substantially neutral at a pH over the pKa. The LNPs and LNP compositions may be safely delivered to a target organ (for example, the liver, lung, heart, spleen, as well as to tumors) and/or cell (hepatocyte, LSEC, cardiac cell, cancer cell, etc.) in vivo, and during endocytosis, exhibit a positive charge when pH drops below the ionizable lipid pKa to release the encapsulated payload through electrostatic interaction with an anionic lipids of the endosomal membrane.

Early formulations of LNP utilizing permanently cationic lipids resulted in LNPs with positive surface charge that proved toxic in vivo, plus were rapidly cleared by phagocytic cells. By changing to ionizable cationic lipids bearing tertiary amines, especially those with pKa<7, results in LNP achieving efficient encapsulation of nucleic acid polymers at low pH by interacting electrostatically with the negative charges of the phosphate backbone of mRNA, that also result in largely neutral systems at physiological pH values, thus alleviating problems associated with permanently-charged cationic lipids.

As used herein, "ionizable lipid" means an amine-containing lipid which can be easily protonated, and, for example, it may be a lipid of which charge state changes depending on the surrounding pH. The ionizable lipid may be protonated (positively charged) at a pH below the pKa of a cationic lipid, and it may be substantially neutral at a pH over the pKa. In one example, the LNP may comprise a protonated ionizable lipid and/or an ionizable lipid showing neutrality. In some embodiments, the LNP has a pKa of 5 to 8, 5.5 to 7.5, 6 to 7, or 6.5 to 7. The pKa of the LNP is important for in vivo stability and release of the nucleic acid payload of the LNP in the target cell or organ. In some embodiments, the LNP having the foregoing pKa ranges may be safely delivered to a target organ (for example, the liver, lung, heart, spleen, as well as to tumors) and/or target cell (hepatocyte, LSEC, cardiac cell, cancer cell, etc.) in vivo, and inside endosomes, exhibit a positive charge to release the encapsulated payload through electrostatic interaction with an anionic lipids of the endosome membrane.

The ionizable lipid is an ionizable compound having characteristics similar to lipids generally, and through electrostatic interaction with a nucleic acid (for example, an mRNA of the disclosure), may play a role of encapsulating the nucleic acid payloads within the LNP with high efficiency.

According to the type of the amine and the tail group comprised in the ionizable lipid, (i) the nucleic acid encapsulation efficiency, (ii) PDI (polydispersity index) and/or (iii) the nucleic acid delivery efficiency to tissue and/or cells constituting an organ (for example, hepatocytes or liver sinusoidal endothelial cells in the liver) of the LNP may be different. In certain embodiments, the ionizable lipid is an ionizable cationic lipid, and comprises from about 25 mol % to about 66 mol % of the total lipid present in the particle.

The LNP comprising an ionizable lipid comprising an amine may have one or more kinds of the following characteristics: (1) the ability to encapsulate a nucleic acid with high efficiency; (2) uniform size of prepared particles (or having a low PDI value); and/or (3) excellent nucleic acid delivery efficiency to organs such as liver, lung, heart, spleen, bone marrow, as well as to tumors, and/or cells constituting such organs (for example, hepatocytes, LSEC, cardiac cells, cancer cells, etc.).

In particular embodiments, the cationic lipid form plays a crucial role both in nucleic acid encapsulation through electrostatic interactions and intracellular release by disrupting endosomal membranes. The nucleic acid payloads are encapsulated within the LNP by the ionic interactions they form with the positively charged cationic lipid. Non-limiting examples of ionizable cationic lipid components utilized in the LNP of the disclosure are selected from DLin-MC3-DMA (heptatriaconta-6,9,28,31-tetraen-19-yl4-(dimethylamino)butanoate), DLin-KC2-DMA (2,2-dilinoleyl-4-(2-dimethylaminoethyl)-[1,3]-dioxolane), and TNT (1,3,5-triazinane-2,4,6-trione) and TT (N1,N3,N5-tris(2-aminoethyl)benzene-1,3,5-tricarboxamide). Non-limiting examples of helper lipids utilized in the LNP of the disclosure are selected from DSPC (1,2-distearoyl-sn-glycero-3-phosphocholine), POPC (2-Oleoyl-1-palmitoyl-sn-glycero-3-phosphocholine) and DOPE (1,2-Dioleoyl-sn-glycero-3-phosphoethanolamine), 1,2-dioleoyl-sn-glycero-3-phospho-(1'-rac-glycerol) DOPG, 1,2-Dimyristoyl-sn-glycero-3-phosphoethanolamine (DMPE), 1,2-dilauroyl-sn-glycero-3-phosphocholine (DLPC), sphingolipid, and ceramide. Cholesterol and PEG-DMG ((R)-2,3-bis(octadecyloxy)propyl-1-(methoxy polyethylene glycol 2000)carbamate), PEG-DSG (1,2-Distearoyl-rac-glycero-3-methylpolyoxyethylene glycol 2000), or DSPE-PEG2k (1,2-distearoyl-sn-glycero-3-phosphoethanolamine-N-[amino(polyethylene glycol)-

2000]), are components utilized in the LNP of the disclosure for the stability, circulation, and size of the LNP.

In some embodiments, the cationic lipid in the LNP of the disclosure comprises a tertiary amine. In some embodiments, the tertiary amine includes alkyl chains connected to N of the tertiary amine with ether linkages. In some embodiments, the alkyl chains comprise C12-C30 alkyl chains having 0 to 3 double bonds. In some embodiments, the alkyl chains comprise C16-C22 alkyl chains. In some embodiments, the alkyl chains comprise C18 alkyl chains. A number of cationic lipids and related analogs have been described in U.S. Patent Publication Nos. 20060083780, 20060240554, 20110117125, 20190336608, 20190381180 and 20200121809; U.S. Pat. Nos. 5,208,036; 5,264,618; 5,279,833; 5,283,185; 5,753,613; 5,785,992; 9,738,593; 10,106,490; 10,166,298; 10,221,127; and 11,219,634; and PCT Publication No. WO 96/10390, the disclosures of which are herein incorporated by reference in their entirety.

In some embodiments, the cationic lipid in the LNP of the disclosure may comprise, for example, one or more ionizable cationic lipids wherein the ionizable cationic lipid is a dialkyl lipid. In other embodiments, the ionizable cationic lipid is a tetraalkyl lipid.

In some embodiments, the cationic lipid in the LNP of the disclosure is selected from 1,2-dilinoleyloxy-N,N-dimethylaminopropane (DLinDMA), 1,2-dilinolenyloxy-N,N-dimethylaminopropane (DLenDMA), 2,2-dilinoleyl-4-(2-dimethylaminoethyl)-[1,3]-dioxolane (DLin-K-C2-DMA), 2,2-dilinoleyl-4-(3-dimethylaminopropyl)-[1,3]-dioxolane (DLin-K-C3-DMA), 2,2-dilinoleyl-4-(4-dimethylaminobutyl)-[1,3]-dioxolane (DLin-K-C4-DMA), 2,2-dilinoleyl-5-dimethylaminomethyl-[1,3]-dioxane (DLin-K6-DMA), 2,2-dilinoleyl-4-N-methylpepiazino-[1,3]-dioxolane (DLin-K-MPZ), 2,2-dilinoleyl-4-dimethylaminomethyl-[1,3]-dioxolane (DLin-K-DMA), 1,2-dilinoleylcarbamoyloxy-3-dimethylaminopropane (DLin-C-DAP), 1,2-dilinoleyoxy-3-(dimethylamino) acetoxypropane (DLin-DAC), 1,2-dilinoleyoxy-3-morpholinopropane (DLin-MA), 1,2-dilinoleoyl-3-dimethylaminopropane (DLinDAP), 1,2-dilinoleylthio-3-dimethylaminopropane (DLin-S-DMA), 1-linoleoyl-2-linoleyloxy-3-dimethylaminopropane (DLin-2-DMAP), 1,2-dilinoleyloxy-3-trimethylaminopropane chloride salt (DLin-TMA.Cl), 1,2-dilinoleoyl-3-trimethylaminopropane chloride salt (DLin-TAP.Cl), 1,2-dilinoleyloxy-3-(N-methylpiperazino)propane (DLin-MPZ), 3-(N,N-dilinoleylamino)-1,2-propanediol (DLinAP), 3-(N,N-dioleylamino)-1,2-propanedio (DOAP), 1,2-dilinoleyloxo-3-(2-N,N-dimethylamino) ethoxypropane (DLin-EG-DMA), N,N-dioleyl-N,N-dimethylammonium chloride (DODAC), 1,2-dioleyloxy-N,N-dimethylaminopropane (DODMA), 1,2-distearyloxy-N,N-dimethylaminopropane (DSDMA), N-(1-(2,3-dioleyloxy)propyl)-N,N,N-trimethylammonium chloride (DOTMA), N,N-distearyl-N,N-dimethylammonium bromide (DDAB), N-(1-(2,3-dioleoyloxy)propyl)-N,N,N-trimethylammonium chloride (DOTAP), 3-(N—(N',N'-dimethylaminocthane)-carbamoyl)cholesterol (DC-Chol), N-(1,2-dimyristyloxyprop-3-yl)-N,N-dimethyl-N-hydroxyethyl ammonium bromide (DMRIE), 2,3-dioleyloxy-N-[2 (spermine-carboxamido)ethyl]-N,N-dimethyl-1-propanaminiumtrifluoroacetate (DOSPA), dioctadecylamidoglycyl spermine (DOGS), 3-dimethylamino-2-(cholest-5-en-3-beta-oxybutan-4-oxy)-1-(cis,cis-9,12-octadecadienoxy)propane (CLinDMA), 2-[5'-(cholest-5-en-3-beta-oxy)-3'-oxapentoxy)-3-dimethyl-1-(cis,cis-9',1-2'-octadecadienoxy)propane (CpLinDMA), N,N-dimethyl-3,4-dioleyloxybenzylamine (DMOBA), 1,2-N,N'-dioleylcarbamyl-3-dimethylaminopropane (DOcarbDAP), 1,2-N,N'-dilinoleylcarbamyl-3-dimethylaminopropane (DLincarbDAP), and any combination of the forgoing.

In some embodiments, the cationic lipid in the LNP of the disclosure is selected from heptatriaconta-6,9,28,31-tetraen-19-yl4-(dimethylamino)butanoate (DLin-MC3-DMA), 2,2-dilinoleyl-4-(2-dimethylaminoethyl)-[1,3]-dioxolane (DLin-KC2-DMA), (1,3,5-triazinane-2,4,6-trione) (TNT), N1,N3,N5-tris(2-aminoethyl)benzene-1,3,5-tricarboxamide (TT), and any combination of the forgoing.

In some embodiments, the N/P ratio (nitrogen from the cationic/ionizable lipid and phosphate from the nucleic acid) in the LNP of the disclosure is in the range of is about 3:1 to 7:1, or about 4:1 to 6:1, or is 3:1, or is 4:1, or is 5:1, or is 6:1, or is 7:1, or is 8:1, or is 9:1.

Conjugated Lipid

In some embodiments, the LNPs and LNP compositions of the present disclosure include at least one conjugated lipid. In some embodiments, the conjugated lipid may be selected from a polyethyleneglycol (PEG)-lipid conjugate, a polyamide (ATTA)-lipid conjugate, a cationic-polymer-lipid conjugate (CPL), and any combination of the foregoing. In some cases, conjugated lipids can inhibit aggregation of the LNPs of the disclosure.

In some embodiments, the conjugated lipid of the LNP of the disclosure comprises a pegylated lipid. The terms "polyethyleneglycol (PEG)-lipid conjugate," "pegylated lipid" "lipid-PEG conjugate", "lipid-PEG", "PEG-lipid", "PEG-lipid", or "lipid-PEG" are used interchangeably herein and refer to a lipid attached to a polyethylene glycol (PEG) polymer which is a hydrophilic polymer. The pegylated lipid contributes to the stability of the LNPs and LNP compositions and reduces aggregation of the LNPs. In other embodiments, the lipid of the LNP comprises peptide modified PEG lipids that are used for targeting cell surface receptors Ex: DSPE-PEG-RGD, DSPE-PEG-Transferrin, DSPE-PEG-cholesterol.

As the PEG-lipid can form the surface lipid, the size of the LNP can be readily varied by varying the proportion of surface (PEG) lipid to the core (ionizable cationic) lipids. In some embodiments, the PEG-lipid of the LNP of the disclosure can be varied from ~1 to 5 mol % to modify particle properties such as size, stability, and circulation time.

The lipid-PEG conjugate contributes to the particle stability in serum of the nanoparticle within the LNP, and plays a role of preventing aggregation between nanoparticles. In addition, the lipid-PEG conjugate may protect nucleic acids, such as mRNAs encoding the repressor fusion proteins of the disclosure, or gRNAs of the disclosure, from degrading enzymes during in vivo delivery of the nucleic acids and enhance the stability of the nucleic acids in vivo and increase the half-life of the delivered nucleic acids encapsulated in the nanoparticle. Examples of PEG-lipid conjugates include, but are not limited to, PEG-DAG conjugates, PEG-DAA conjugates, and mixtures thereof. In certain embodiments, the PEG-lipid conjugate is selected from the group consisting of a PEG-diacylglycerol (PEG-DAG) conjugate, a PEG-dialkyloxypropyl (PEG-DAA) conjugate, a PEG-phospholipid conjugate, a PEG-ceramide (PEG-Cer) conjugate, and a mixture thereof.

In some embodiments, the pegylated lipid of the LNP of the disclosure is selected from a PEG-ceramide, a PEG-diacylglycerol, a PEG-dialkyloxypropyl, a PEG-dialkoxypropylcarbamate, a PEG-phosphatidylethanoloamine, a PEG-phospholipid, a PEG-succinate diacylglycerol, and any combination of the foregoing.

In some embodiments, the pegylated lipid of the LNP of the disclosure is a PEG-dialkyloxypropyl. In some embodiments, the pegylated lipid is selected from PEG-didecyloxypropyl (C10), PEG-dilauryloxypropyl (C12), PEG-dimyristyloxypropyl (C14), PEG-dipalmityloxypropyl (C16), PEG-distearyloxypropyl (C18), and any combination of the foregoing.

In other embodiments, the lipid-PEG conjugate of the LNP of the disclosure may be PEG bound to phospholipid such as phosphatidylethanolamine (PEG-PE), PEG conjugated to ceramide (PEG-CER, ceramide-PEG conjugate, ceramide-PEG, cholesterol or PEG conjugated to derivative thereof, PEG-c-DOMG, PEG-DMG, PEG-DLPE, PEG-DMPE, PEG-DPPC, PEG-DSPE (DSPE-PEG), and a mixture thereof, and for example, may be C16-PEG2000 ceramide (N-palmitoyl-sphingosine-1-{succinyl [methoxy (polyethylene glycol) 2000]}), DMG-PEG 2000, 14:0 PEG2000 PE.

In some embodiments, the pegylated lipid of the LNP of the disclosure is selected from 1-(monomethoxy-polyethyleneglycol)-2,3-dimyristoylglycerol, 4-O-(2',3'-di(tetradecanoyloxy)propyl-1-O-(ω-methoxy(polyethoxy)ethyl) butanedioate (PEG-S-DMG), ω-methoxy(polyethoxy)ethyl-N-(2,3-di(tetradecanoxy)propyl)carbamate, 2,3-di(tetradecanoxy)propyl-N-(ω-methoxy(polyethoxy)ethyl)carbamate, and any combination of the foregoing.

In some embodiments, the pegylated lipid of the LNP of the disclosure is selected from mPEG2000-1,2-di-O-alkyl-sn3-carbomoylglyceride (PEG-C-DOMG), 1-[8'-(1,2-dimyristoyl-3-propanoxy)-carboxamido-3',6'-dioxaoctanyl] carbamoyl-w-methyl-poly(ethylene glycol) (2 KPEG-DMG), and any combination of the foregoing.

In some embodiments, the PEG is directly attached to the lipid of the pegylated lipid. In other embodiments, the PEG is attached to the lipid of the pegylated lipid by a linker moiety selected from an ester-free linker moiety or an ester-containing linker moiety. Non-limiting examples of the ester-free linker moiety include amido (—C(O)NH—), amino (—NR—), carbonyl (—C(O)—), carbamate (—NHC (O)O—), urea (—NHC(O)NH—), disulfide (—S—S—), ether (—O—), succinyl (—(O)CCH2CH2C(O)—), succinamidyl (—NHC(O)CH2CH2C(O)NH—), ether, disulfide and combinations thereof. For example, the linker may contain a carbamate linker moiety and an amido linker moiety. Non-limiting examples of the ester-containing linker moiety include carbonate (—OC(O)O—), succinoyl, phosphate ester (—O—(O)POH—O—), sulfonate ester, and combinations thereof.

The PEG moiety of the pegylated lipid of the LNP of the disclosure described herein may have an average molecular weight ranging from about 550 daltons to about 10,000 daltons. In certain embodiments, the PEG moiety has an average molecular weight of from about 750 daltons to about 5,000 daltons, about 1,000 daltons to about 4,000 daltons, about 1,500 daltons to about 3,000 daltons, about 750 daltons to about 3,000 daltons, or about 1750 daltons to about 2,000 daltons.

In some embodiments, the conjugated lipid (e.g., pegylated lipid) comprises from about 1 mol % to about 60 mol %, from about 2 mol % to about 50 mol %, from about 5 mol % to about 40 mol %, or from about 5 mol % to about 20 mol % of the total lipid present in the LNPs and/or LNP compositions. In certain embodiments, the conjugated lipid comprises from about 0.5 mol % to about 3 mol % of the total lipid present in the particle.

In additional embodiments, the conjugated lipid (e.g., pegylated lipid) of the LNP of the disclosure comprises at least about 1, 2, 5, 10, 15, 20, 25, 30, 35, 40, 45, 50, 55, or 60 mol %, or an intermediate range of any of the foregoing, of the total lipid present in the LNPs and/or LNP compositions.

For the lipid in the lipid-PEG conjugate of the LNP of the disclosure, any lipid capable of binding to polyethyleneglycol may be used without limitation, and the phospholipid and/or cholesterol which are other elements of the LNP may be also used. In some embodiments, the lipid in the lipid-PEG conjugate may be ceramide, dimyristoylglycerol (DMG), succinoyl-diacylglycerol (s-DAG), distearoylphosphatidylcholine (DSPC), distearoylphosphatidylethanolamine (DSPE), or cholesterol, but not limited thereto.

In the lipid-PEG conjugate of the LNP of the disclosure, the PEG may be directly conjugated to the lipid or linked to the lipid via a linker moiety. Any linker moiety suitable for binding PEG to the lipid may be used, and for example, includes an ester-free linker moiety and an ester-containing linker moiety. The ester-free linker moiety includes not only amido (—C(O)NH—), amino (—NR—), carbonyl (—C (O)—), carbamate (—NHC(O)O—), urea (—NHC(O) NH—), disulfide (—S—S—), ether (—O—), succinyl (—(O)CCH2CH2C(O)—), succinamidyl (—NHC(O) CH2CH2C(O)NH—), ether, disulfide but also combinations thereof (for example, a linker containing both a carbamate linker moiety and an amido linker moiety), but not limited thereto. The ester-containing linker moiety includes for example, carbonate (—OC(O)O—), succinoyl, phosphate ester (—O—(O)POH—O—), sulfonate ester, and combinations thereof, but not limited thereto.

Steroids

In some embodiments, the LNPs and LNP compositions of the present disclosure include at least one steroid or derivative thereof. In some embodiments, the steroid comprises cholesterol. In some embodiments, the LNPs and LNP compositions comprise a cholesterol derivative selected from cholestanol, cholestanone, cholestenone, coprostanol, cholesteryl-2'-hydroxyethyl ether, cholesteryl-4'-hydroxybutyl ether, and any combination of the foregoing.

In some embodiments, the steroid (e.g., cholesterol) of the LNP of the disclosure comprises from about 1 mol % to about 65 mol %, from about 2 mol % to about 50 mol %, from about 5 mol % to about 40 mol %, or from about 5 mol % to about 20 mol % of the total lipid present in the LNPs and/or LNP compositions. In other embodiments, the steroid (e.g., cholesterol) of the LNP of the disclosure comprises at least about 1, 2, 5, 10, 15, 20, 25, 30, 35, 40, 45, 50, 55, or 60 mol %, or an intermediate range of any of the foregoing, of the total lipid present in the LNPs and/or LNP compositions.

Helper Lipid/Helper Lipid or Structural Lipid

In some embodiments, the LNPs and LNP compositions of the present disclosure include at least one helper lipid. In some embodiments, the helper lipid is non-cationic lipid selected from an anionic lipid, a neutral lipid, or both. In some embodiments, the helper lipid comprises at least one phospholipid. In some embodiments, the phospholipid is selected from an anionic phospholipid, a neutral phospholipid, or both. The phospholipid of the elements of the LNPs and LNP compositions can play a role in covering and protecting a core of the LNP formed by interaction of the cationic lipid and nucleic acid in the LNP, and may facilitate cell membrane permeation and endosomal escape during intracellular delivery of the nucleic acid by binding to the phospholipid bilayer of a target cell. A phospholipid which can promote fusion of the LNP to a cell may include without limitation, any of the phospholipids selected from the group described below.

In some embodiments, the LNPs and LNP compositions comprise at least one phospholipid selected from, but not limited to, dipalmitoyl-phosphatidylcholine (DPPC), distearoyl-phosphatidylcholine (DSPC), dioleoyl-phosphatidylethanolamine (DOPE), dioleoyl-phosphatidylcholine (DOPC), dioleoyl-phosphatidylglycerol (DOPG), palmitoyloleoyl-phosphatidylcholine (POPC), palmitoyloleoyl-phosphatidylethanolamine (POPE), palmitoyloleyol-phosphatidylglycerol (POPG), dipalmitoyl-phosphatidylethanolamine (DPPE), dipalmitoyl-phosphatidylglycerol (DPPG), dimyristoyl-phosphatidylethanolamine (DMPE), distearoyl-phosphatidylethanolamine (DSPE), monomethyl-phosphatidylethanolamine, dimethyl-phosphatidylethanolamine, dielaidoyl-phosphatidylethanolamine (DEPE), stearoyloleoyl-phosphatidylethanolamine (SOPE), egg phosphatidylcholine (EPC), phosphatidylethanolamine (PE), 1,2-dioleoyl-sn-glycero-3-phosphoethanolamine, 1-palmitoyl-2-oleoyl-sn-glycero-3-phosphocholine (POPC), 1,2-dioleoyl-sn-glycero-3-[phospho-L-serine] (DOPS), 1,2-dioleoyl-sn-glycero-3-[phospho-L-serine], and any combination of the foregoing. In one example, the LNP comprising DOPE may be effective in mRNA delivery (excellent drug delivery efficacy).

In some embodiments, the helper lipid (e.g., phospholipid) of the LNP of the disclosure comprises from about 1 mol % to about 60 mol %, from about 2 mol % to about 50 mol %, from about 5 mol % to about 40 mol %, or from about 5 mol % to about 20 mol % of the total lipid present in the LNPs and/or LNP compositions. In other embodiments, the helper lipid (e.g., phospholipid) of the LNP of the disclosure comprises at least about 1, 2, 5, 10, 15, 20, 25, 30, 35, 40, 45, 50, 55, or 60 mol %, or an intermediate range of any of the foregoing, of the total lipid present in the LNPs and/or LNP compositions.

It will be appreciated that the total lipid present in the LNPs and/or LNP compositions comprises the lipids as individual or in combination of the cationic lipid or ionizable cationic lipid, the conjugated lipid, (e.g., pegylated lipid), the peptide conjugated PEG lipid, the steroid (e.g., cholesterol), peptide conjugated-structural lipid (Ex: DSPE-cRGD) and the structural lipid (e.g., phospholipid), leading from LNP formulation containing one to multi-component but not limited to one, two, three, four or five components in an LNP formulation.

The LNPs and/or LNP compositions may be prepared by dissolving the total lipids (or a portion thereof) in an organic solvent (e.g., ethanol) followed by mixing through a micromixer with the payload (e.g., nucleic acids of the systems) dissolved in an acidic buffer (e.g., pH between 1.0-6.5). At this pH the ionizable cationic lipid is positively charged and interacts with the negatively-charged nucleic acid polymers. The resulting nanostructures containing the nucleic acids are then converted to neutral LNPs when dialyzed against a neutral buffer which also includes removal of the organic solvent (e.g., ethanol) during the exchange of LNPs into physiologically relevant buffer. The LNPs and/or LNP compositions thus formed have a distinct electron-dense nanostructured core where the cationic lipids are organized into inverted micelles around the encapsulated payload, as opposed to traditional bilayer liposomal structures. In another embodiment, the LNP may form a bleb-like structure with nucleic acids in aqueous pockets along the non-electron dense lipid core.

b. Lipid Nanoparticle Properties

The LNPs and/or LNP compositions may be prepared by dissolving the total lipids (or a portion thereof) in an organic solvent (e.g., ethanol) followed by mixing through a micromixer with the payload (e.g., nucleic acids of the systems) dissolved in an acidic buffer (e.g., pH between 1.0-6.5). At this pH the ionizable cationic lipid is positively charged and interacts with the negatively-charged nucleic acid polymers. The resulting nanostructures containing the nucleic acids are then converted to neutral LNPs when dialyzed against a neutral buffer which also includes removal of the organic solvent (e.g., ethanol) during the exchange of LNPs into physiologically relevant buffer. The LNPs and/or LNP compositions thus formed have a distinct electron-dense nanostructured core where the cationic lipids are organized into inverted micelles around the encapsulated payload, as opposed to traditional bilayer liposomal structures. In another embodiment, the LNP may form a bleb-like structure with nucleic acids in aqueous pockets along the non-electron dense lipid core.

In some embodiments, the LNPs and/or LNP compositions of the disclosure comprise cationic lipid: helper lipid (e.g., phospholipid): steroid (e.g., cholesterol): conjugated lipid, (e.g., pegylated lipid) at a molar ratio of 20 to 50:10 to 30:30 to 60:0.5 to 5, at a molar ratio of 25 to 45:10 to 25:40 to 50:0.5 to 3, at a molar ratio of 25 to 45:10 to 20:40 to 55:0.5 to 3, or at a molar ratio of 25 to 45:10 to 20:40 to 55:1.0 to 1.5.

In some embodiments, the LNPs and/or LNP compositions of the disclosure have a total lipid:payload ratio (mass/mass) of from about 1 to about 100. In some embodiments, the total lipid:payload ratio is about 1 to about 50, from about 2 to about 25, from about 3 to about 20, from about 4 to about 15, or from about 5 to about 10. In some embodiments, the total lipid:payload ratio is about 5 to about 15, e.g., about 5, 6, 7, 8, 9, 10, 11, 12, 13, 14, 15, or an intermediate range of any of the foregoing.

In certain embodiments, the LNPs of the disclosure comprise a total lipid: nucleic acid mass ratio of from about 5:1 to about 15:1. In some embodiments, the weight ratio of the cationic lipid and nucleic acid comprised in the LNP may be 1 to 20:1, 1 to 15:1, 1 to 10:1, 5 to 20:1, 5 to 15:1, 5 to 10:1, 7.5 to 20:1, 7.5 to 15:1, or 7.5 to 10:1.

In some embodiments, the LNP of the disclosure may comprise the cationic lipid of 20 to 50 parts by weight, the phospholipid of 10 to 30 parts by weight, cholesterol of 20 to 60 parts by weight (or 20 to 60 parts by weight), and lipid-PEG conjugate of 0.1 to 10 parts by weight (or 0.25 to 10 parts by weight, 0.5 to 5 parts by weight). Alternatively, the LNP may comprise the cationic lipid of 20 to 50% by weight, phospholipid of 10 to 60% by weight, cholesterol of 20 to 60% by weight (or 30 to 60% by weight), and lipid-PEG conjugate of 0.1 to 10% by weight (or 0.25 to 10% by weight, 0.5 to 5% by weight) based on the total nanoparticle weight. As a further alternative, the LNP may comprise the cationic lipid of 25 to 50% by weight, phospholipid of 10 to 20% by weight, cholesterol of 35 to 55% by weight, and lipid-PEG conjugate of 0.1 to 10% by weight (or 0.25 to 10% by weight, 0.5 to 5% by weight), based on the total nanoparticle weight.

In some embodiments, the LNPs of the present disclosure have a mean diameter of from about 20 to 200 nm, 20 to 180 nm, 20 to 170 nm, 20 to 150 nm, 20 to 120 nm, 20 to 100 nm, 20 to 90 nm, 30 to 200 nm, 30 to 180 nm, 30 to 170 nm, 30 to 150 nm, 30 to 120 nm, 30 to 100 nm, 30 to 90 nm, 40 to 200 nm, 40 to 180 nm, 40 to 170 nm, 40 to 150 nm, 40 to 120 nm, 40 to 100 nm, 40 to 90 nm, 40 to 80 nm, 40 to 70 nm, 50 to 200 nm, 50 to 180 nm, 50 to 170 nm, 50 to 150 nm, 50 to 120 nm, 50 to 100 nm, 50 to 90 nm, 60 to 200 nm, 60 to 180 nm, 60 to 170 nm, 60 to 150 nm, 60 to 120 nm, 60 to 100 nm, 60 to 90 nm, 70 to 200 nm, 70 to 180 nm, 70 to 170 nm, 70 to 150 nm, 70 to 120 nm, 70 to 100 nm, 70 to 90 nm, 80 to 200 nm, 80 to 180 nm, 80 to 170 nm, 80 to 150 nm, 80 to 120 nm, 80 to 100 nm, 80 to 90 nm, 90 to 200 nm, 90 to 180 nm, 90 to 170 nm, 90 to 150 nm, 90 to 120 nm, or 90 to 100 nm, or an intermediate range of any of the foregoing.

In some embodiments, the LNPs and/or LNP compositions of the disclosure have a positive charge at acidic pH and may encapsulate the payload (e.g., therapeutic agent) through electrostatic interaction produced by negative charges of the payload (e.g., therapeutic agent). The term "encapsulation," refers to the mixture of lipids surrounding and embedding the payload (e.g., therapeutic agent) at physiological conditions, forming the LNPs. The term "encapsulation efficiency," as used herein is the percent amount of payload (e.g., therapeutic agent) encapsulated by the LNPs. It is a measure of payload (e.g., therapeutic agent) in bulk before disruption of LNPs divided by the total amount of payload (e.g., therapeutic agent) measured in bulk post-disruption of LNPs using a surfactant based reagent such as 1-2% Triton™ X-100. The encapsulation efficiency of the LNPs and/or LNP compositions may be 70% or more, 75% or more, 80% or more, 85% or more, 90% or more, 91% or more, 92% or more, 94% or more, or 95% or more. In other embodiments, the encapsulation efficiency of the LNPs and/or LNP compositions is about 80% to 99%, about 85% to 98%, about 88% to 95%, about 90% to 95%, or the payload (e.g., nucleic acids of the systems) may be fully encapsulated within the lipid portion of the LNPs compositions, and thereby protected from enzymatic degradation. In some embodiments, the payload (e.g., therapeutic agent) is not substantially degraded after exposure of the LNPs and/or LNP compositions to a nuclease at 37° C. for at least about 20, 30, 45, or 60 minutes or at least about 2, 3, 4, 5, 6, 7, 8, 9, 10, 12, 14, 16, 18, 20, 22, 24, 26, 28, 30, 32, 34, or 36 hours. In some embodiments, the payload (e.g., nucleic acids of the systems) is complexed with the lipid portion of the LNPs and/or LNP compositions. The LNPs and/or LNP compositions of the present disclosure are non-toxic to mammals such as humans.

The term "fully encapsulated" indicates that the payload (e.g., the nucleic acids of the system) in the LNPs and/or LNP compositions is not significantly degraded after exposure to conditions that significantly degrade free DNA, RNA, or protein. In a fully encapsulated system, less than about 25%, more preferably less than about 10%, and most preferably less than about 5% of the payload (e.g., nucleic acids of the system) in the LNPs and/or LNP compositions is degraded by conditions that would degrade 100% of a non-encapsulated payload. "Fully encapsulated" also indicates that the LNPs and/or LNP compositions are serum-stable, and do not decompose into their component parts immediately upon exposure to serum proteins post in vivo administration and protects the cargo until endosomal escape and release into cytoplasm of the cell.

In some embodiments, the amount of the LNPs and/or LNP compositions having the payload (e.g., therapeutic agent), encapsulated therein is from about 30% to about 100%, from about 40% to about 100%, from about 50% to about 100%, from about 60% to about 100%, from about 70% to about 100%, from about 80% to about 100%, from about 90% to about 100%, from about 30% to about 95%, from about 40% to about 95%, from about 50% to about 95%, from about 60% to about 95%, %, from about 70% to about 95%, from about 80% to about 95%, from about 85% to about 95%, from about 90% to about 95%, from about 30% to about 90%, from about 40% to about 90%, from about 50% to about 90%, from about 60% to about 90%, from about 70% to about 90%, from about 80% to about 90%, or at least about 30%, 35%, 40%, 45%, 50%, 55%, 60%, 65%, 70%, 75%, 80%, 85%, 90%, 91%, 92%, 93%, 94%, 95%, 96%, 97%, 98%, 99%, or an intermediate range of any of the foregoing.

In some embodiments, the amount of the payload (e.g., the nucleic acids), encapsulated within the LNPs and/or LNP compositions is from about 30% to about 100%, from about 40% to about 100%, from about 50% to about 100%, from about 60% to about 100%, from about 70% to about 100%, from about 80% to about 100%, from about 90% to about 100%, from about 30% to about 95%, from about 40% to about 95%, from about 50% to about 95%, from about 60% to about 95%, %, from about 70% to about 95%, from about 80% to about 95%, from about 85% to about 95%, from about 90% to about 95%, from about 30% to about 90%, from about 40% to about 90%, from about 50% to about 90%, from about 60% to about 90%, from about 70% to about 90%, from about 80% to about 90%, or at least about 30%, 35%, 40%, 45%, 50%, 55%, 60%, 65%, 70%, 75%, 80%, 85%, 90%, 91%, 92%, 93%, 94%, 95%, 96%, 97%, 98%, 99%, or an intermediate range of any of the foregoing.

In some embodiments, the nucleic acids of the disclosure, such as the mRNA encoding the repressor fusion protein, and/or the gRNA, may be provided in a solution to be mixed with a lipid solution such that the nucleic acids may be encapsulated in the lipid nanoparticles. A suitable nucleic acid solution may be any aqueous solution containing the nucleic acid to be encapsulated at various concentrations. For example, a suitable nucleic acid solution may contain the nucleic acid (or nucleic acids) at a concentration of or greater than about 0.01 mg/ml, 0.05 mg/ml, 0.06 mg/ml, 0.07 mg/ml, 0.08 mg/ml, 0.09 mg/ml, 0.1 mg/ml, 0.15 mg/ml, 0.2 mg/ml, 0.3 mg/ml, 0.4 mg/ml, 0.5 mg/ml, 0.6 mg/ml, 0.7 mg/ml, 0.8 mg/ml, 0.9 mg/ml, 1.0 mg/ml, 1.25 mg/ml, 1.5 mg/ml, 1.75 mg/ml, or 2.0 mg/ml. In some embodiments, the nucleic acid comprises an mRNA encoding a repressor fusion protein, and a suitable mRNA solution may contain the mRNA at a concentration ranging from about 0.01-2.0 mg/ml, 0.01-1.5 mg/ml, 0.01-1.25 mg/ml, 0.01-1.0 mg/ml, 0.01-0.9 mg/ml, 0.01-0.8 mg/ml, 0.01-0.7 mg/ml, 0.01-0.6 mg/ml, 0.01-0.5 mg/ml, 0.01-0.4 mg/ml, 0.01-0.3 mg/ml, 0.01-0.2 mg/ml, 0.01-0.1 mg/ml, 0.05-1.0 mg/ml, 0.05-0.9 mg/ml, 0.05-0.8 mg/ml, 0.05-0.7 mg/ml, 0.05-0.6 mg/ml, 0.05-0.5 mg/ml, 0.05-0.4 mg/ml, 0.05-0.3 mg/ml, 0.05-0.2 mg/ml, 0.05-0.1 mg/ml, 0.1-1.0 mg/ml, 0.2-0.9 mg/ml, 0.3-0.8 mg/ml, 0.4-0.7 mg/ml, or 0.5-0.6 mg/ml. In some embodiments, a suitable mRNA solution may contain an mRNA at a concentration up to about 5.0 mg/ml, 4.0 mg/ml, 3.0 mg/ml, 2.0 mg/ml, 1.0 mg/ml, 0.9 mg/ml, 0.8 mg/ml, 0.7 mg/ml, 0.6 mg/ml, 0.5 mg/ml, 0.4 mg/ml, 0.3 mg/ml, 0.2 mg/ml, 0.1 mg/ml, 0.05 mg/ml, 0.04 mg/ml, 0.03 mg/ml, 0.02 mg/ml, 0.01 mg/ml, or 0.05 mg/ml. In some embodiments, a suitable gRNA solution may contain an gRNA at a concentration up to about 5.0 mg/ml, 4.0 mg/ml, 3.0 mg/ml, 2.0 mg/ml, 1.0 mg/ml, 0.9 mg/ml, 0.8 mg/ml, 0.7 mg/ml, 0.6 mg/ml, 0.5 mg/ml, 0.4 mg/ml, 0.3 mg/ml, 0.2 mg/ml, 0.1 mg/ml, 0.05 mg/ml, 0.04 mg/ml, 0.03 mg/ml, 0.02 mg/ml, 0.01 mg/ml, or 0.05 mg/ml.

In some embodiments, the LNP may have an average diameter of 20 nm to 200 nm, 20 to 180 nm, 20 nm to 170 nm, 20 nm to 150 nm, 20 nm to 120 nm, 20 nm to 100 nm, 20 nm to 90 nm, 30 nm to 200 nm, 30 to 180 nm, 30 nm to 170 nm, 30 nm to 150 nm, 30 nm to 120 nm, 30 nm to 100 nm, 30 nm to 90 nm, 40 nm to 200 nm, 40 to 180 nm, 40 nm to 170 nm, 40 nm to 150 nm, 40 nm to 120 nm, 40 nm to 100 nm, 40 nm to 90 nm, 40 nm to 80 nm, 40 nm to 70 nm, 50 nm to 200 nm, 50 to 180 nm, 50 nm to 170 nm, 50 nm to 150 nm, 50 nm to 120 nm, 50 nm to 100 nm, 50 nm to 90 nm, 60 nm to 200 nm, 60 to 180 nm, 60 nm to 170 nm, 60 nm to 150 nm, 60 nm to 120 nm, 60 nm to 100 nm, 60 nm to 90 nm, 70 nm to 200 nm, 70 to 180 nm, 70 nm to 170 nm, 70 nm to 150 nm, 70 nm to 120 nm, 70 nm to 100 nm, 70 nm to 90 nm, 80 nm to 200 nm, 80 to 180 nm, 80 nm to 170 nm, 80 nm to 150 nm, 80 nm to 120 nm, 80 nm to 100 nm, 80 nm to 90 nm, 90 nm to 200 nm, 90 to 180 nm, 90 nm to 170 nm, 90 nm to 150 nm, 90 nm to 120 nm, or 90 nm to 100 nm for easy introduction into liver tissue, hepatocytes and/or LSEC (liver sinusoidal endothelial cells). The LNP may be sized for easy introduction into organs or tissues, including but not limited to liver, lung, heart, spleen, as well as to tumors. When the size of the LNP is smaller than the above range, it can be difficult to maintain stability as the surface area of the LNP is excessively increased, and thus delivery to the target tissue and/or drug effect may be reduced. The LNP may specifically target liver tissue. Without wishing to be bound by theory, it is thought that one mechanism by which LNP may be used to deliver therapeutic agents is through the imitation of the metabolic behaviors of natural lipoproteins, and so LNP may be usefully delivered to a subject through the lipid metabolism processes carried out by the liver. During the delivery of therapeutic agents to hepatocytes or and/or LSEC (liver sinusoidal endothelial cells), the diameter of the fenestrae leading from the sinusoidal lumen to the hepatocytes and LSEC is about 140 nm in mammals and about 100 nm in humans, so the LNP composition for therapeutic agent delivery having LNPs with a diameter in the above ranges may have excellent delivery efficiency to hepatocytes and LSEC when compared to LNP having the diameter outside the above range.

According to one example, the LNPs of the LNP composition may comprise the ionizable cationic lipid:phospholipid:cholesterol:lipid-PEG conjugate in the range described above or at a molar ratio of 20 to 50:10 to 30:30 to 60:0.5 to 5, at a molar ratio of 25 to 45:10 to 25:40 to 50:0.5 to 3, at a molar ratio of 25 to 45:10 to 20:40 to 55:0.5 to 3, or at a molar ratio of 25 to 45:10 to 20:40 to 55:1.0 to 1.5. The LNP comprising components at a molar ratio in the above range may have excellent delivery efficiency of therapeutic agents specific to cells of target organs.

In certain aspects, the LNP exhibit a positive charge under the acidic pH condition by showing a pKa of 5 to 8, 5.5 to 7.5, 6 to 7, or 6.5 to 7, and may encapsulate a nucleic acid with high efficiency by easily forming a complex with a nucleic acid through electrostatic interaction with a therapeutic agent such as a nucleic acid showing a negative charge. In such cases, the LNP may be usefully used as a composition for intracellular or in vivo delivery of a therapeutic agent (for example, nucleic acid).

Herein, "encapsulate" or "encapsulation" refers to incorporation of a therapeutic agent efficiently inside a lipid envelope, i.e., by surrounding it by the particle surface and/or embedding it within the particle interior made of various lipids that self-assemble when the polarity of the solvent surrounding them is increased. The encapsulation efficiency means the content of the therapeutic agent encapsulated in the LNP relative the total therapeutic agent content measured per given volume of the LNP formulation measured post-disruption of the LNPs.

The encapsulation of the nucleic acids of the composition in the LNP may be 70% or more, 75% or more, 80% or more, 85% or more, 90% or more, 91% or more, 92% or more, 94% or more, or 95% or more of LNP in the composition encapsulate nucleic acids. In some embodiments, the encapsulation of the nucleic acids of the composition in the LNP is such that between 80% to 99%, between 80% to 97%, between 80% to 95%, between 85% to 95%, between 87% to 95%, between 90% to 95%, between 91% or more to 95% or less, 91% or more to 94% or less, over 91% to 95% or less, 92% to 99%, between 92% to 97%, or between 92% to 95% of the LNP in the composition encapsulate nucleic acids. In some embodiments, the mRNA encoding the repressor fusion protein and/or a gRNA of any of the embodiments of the disclosure are fully encapsulated in the LNP.

The target organs to which a nucleic acid is delivered by the LNP include, but are not limited to the liver, lung, heart, spleen, as well as to tumors. The LNP according to one example is liver tissue-specific and has excellent biocompatibility and can deliver the nucleic acids of a composition with high efficiency, and thus it can be usefully used in related technical fields such as lipid nanoparticle-mediated gene therapy. In a particular embodiment, the target cell to which the nucleic acids are delivered by the LNP according to one example may be a hepatocyte and/or LSEC in vivo. In other embodiments, the disclosure provides LNP formulated for delivery of the nucleic acids of the embodiments to cells ex vivo.

The disclosure provides a pharmaceutical composition comprising a plurality of LNPs comprising nucleic acids, such as mRNA encoding repressor fusion protein and/or a gRNA variant described herein, and a pharmaceutically acceptable carrier.

In certain embodiments, the LNP comprising the nucleic acid(s) has an electron dense core.

The disclosure provides LNP comprising one or more nucleic acids comprising: (a) an mRNA encoding the repressor fusion protein, and/or a gRNA variant described herein; (b) one or more cationic lipids or ionizable cationic lipids or salts thereof comprising from about 20 mol % to about 60 mol % of the total lipid present in the LNP; (c) one or more non-cationic lipids comprising from about 13 mol % to about 49.5 mol % of the total lipid present in the LNP; and (d) one or more conjugated lipids that inhibit aggregation of LNPs comprising from about 0.5 mol % to about 2 mol % of the total lipid present in the particle. In another embodiment, the disclosure provides LNP comprising one or more nucleic acids comprising: (a) an mRNA encoding the repressor fusion protein, and/or a gRNA variant described herein; (b) one or more cationic lipids or ionizable cationic lipids or salts thereof comprising from about 22 mol % to about 85 mol % of the total lipid present in the LNP; (c) one or more non-cationic/phospholipids comprising from about 10 mol % to about 70 mol % of the total lipid present in the LNP; (d) 15 mol % to about 50 mol % sterol, and (d) 1 mol % to about 5 mol % lipid-PEG or lipid-PEG-peptide in the particle. In certain embodiments the repressor fusion protein mRNA and gRNA may be present in the same nucleic acid-lipid particle, or they may be present in different nucleic acid-lipid particles.

The disclosure provides LNP comprising one or more nucleic acids comprising: (a) an mRNA encoding the repressor fusion proteins described herein; (b) a cationic lipid or a salt thereof comprising from about 52 mol % to about 62 mol % of the total lipid present in the LNP; (c) a mixture of a phospholipid and cholesterol or a derivative thereof comprising from about 36 mol % to about 47 mol % of the total lipid present in the LNP; and (d) a PEG-lipid conjugate comprising from about 1 mol % to about 2 mol % of the total lipid present in the LNP. In particular embodiments, the formulation is a four-component system comprising about 1.4 mol % PEG-lipid conjugate (e.g., PEG2000-C-DMA), about 57.1 mol % cationic lipid (e.g., DLin-K-C2-DMA) or a salt thereof, about 7.1 mol % DPPC (or DSPC), and about 34.3 mol % cholesterol (or derivative thereof).

In other embodiments, the LNP comprising one or more nucleic acids comprises: (a) an mRNA encoding the repressor fusion proteins and/or a gRNA of any of the embodiments described herein; (b) a cationic lipid or a salt thereof comprising from about 46.5 mol % to about 66.5 mol % of the total lipid present in the LNP; (c) cholesterol or a derivative thereof comprising from about 31.5 mol % to about 42.5 mol % of the total lipid present in the LNP; and (d) a PEG-lipid conjugate comprising from about 1 mol % to about 2 mol % of the total lipid present in the LNP. In particular embodiments, the formulation is a three-component system which is phospholipid-free and comprises about 1.5 mol % PEG-lipid conjugate (e.g., PEG2000-C-DMA), about 61.5 mol % cationic lipid (e.g., DLin-K-C2-DMA) or a salt thereof, and about 36.9 mol % cholesterol (or derivative thereof).

Additional formulations are described in PCT Publication No. WO 09/127060 and US patent publication numbers US 2011/0071208 A1 and US 2011/0076335 A1, the disclosures of which are herein incorporated by reference in their entirety.

In other embodiments, the LNP comprising one or more nucleic acids comprises: (a) an mRNA encoding the repressor fusion protein and a gRNA of any of the embodiments described herein; (b) one or more cationic lipid or ionizable cationic lipids or salts thereof comprising from about 2 mol % to about 50 mol % of the total lipid present in the LNP; (c) one or more non-cationic lipid or ionizable cationic lipids comprising from about 5 mol % to about 90 mol % of the total lipid present in the LNP; and (d) one or more conjugated lipids that inhibit aggregation of particles comprising from about 0.5 mol % to about 20 mol % of the total lipid present in the LNP.

In other embodiments, the LNP comprising one or more nucleic acids comprises: (a) an mRNA encoding the repressor fusion protein and a gRNA of any of the embodiments described herein; (b) a cationic lipid or a salt thereof comprising from about 30 mol % to about 50 mol % of the total lipid present in the LNP; (c) a mixture of a phospholipid and cholesterol or a derivative thereof comprising from about 47 mol % to about 69 mol % of the total lipid present in the LNP; and (d) a PEG-lipid conjugate comprising from about 1 mol % to about 3 mol % of the total lipid present in the LNP. In particular embodiments, the formulation is a four-component system which comprises about 2 mol % PEG-lipid conjugate (e.g., PEG2000-C-DMA), about 40 mol % cationic lipid (e.g., DLin-K-C2-DMA) or a salt thereof, about 10 mol % DPPC (or DSPC), and about 48 mol % cholesterol (or derivative thereof).

In other embodiments, the LNP comprising one or more nucleic acids comprises: (a) an mRNA encoding the repressor fusion protein and a gRNA of any of the embodiments described herein; (b) one or more cationic lipid or ionizable cationic lipids or salts thereof comprising from about 50 mol % to about 65 mol % of the total lipid present in the LNP; (c) one or more non-cationic lipid or ionizable cationic lipids comprising from about 25 mol % to about 45 mol % of the total lipid present in the LNP; and (d) one or more conjugated lipids that inhibit aggregation of particles comprising from about 5 mol % to about 10 mol % of the total lipid present in the LNP.

In other embodiments, the LNP comprising one or more nucleic acids comprises: (a) an mRNA encoding the repressor fusion protein and a gRNA of any of the embodiments described herein; (b) a cationic lipid or a salt thereof comprising from about 50 mol % to about 60 mol % of the total lipid present in the LNP; (c) a mixture of a phospholipid and cholesterol or a derivative thereof comprising from about 35 mol % to about 45 mol % of the total lipid present in the LNP; and (d) a PEG-lipid conjugate comprising from about 5 mol % to about 10 mol % of the total lipid present in the LNP.

In certain embodiments, the non-cationic lipid mixture in the formulation comprises: (i) a phospholipid of from about 10 mol % to about 70 mol % of the total lipid present in the LNP; (ii) cholesterol or a derivative thereof of from about 15 mol % to about 50 mol % of the total lipid present in the LNP; and 1-5% lipid-PEG or lipid-PEG-peptide. In particular embodiments, the formulation is a four-component system which comprises about 7 mol % PEG-lipid conjugate (e.g., PEG750-C-DMA), about 54 mol % cationic lipid (e.g., DLin-K-C2-DMA) or a salt thereof, about 7 mol % DPPC (or DSPC), and about 32 mol % cholesterol (or derivative thereof).

In other embodiments, the LNP comprising one or more nucleic acids comprises: (a) an mRNA encoding the repressor fusion protein and/or a gRNA of any of the embodiments described herein; (b) a cationic lipid or a salt thereof comprising from about 55 mol % to about 65 mol % of the total lipid present in the LNP; (c) cholesterol or a derivative thereof comprising from about 30 mol % to about 40 mol % of the total lipid present in the LNP; and (d) a PEG-lipid conjugate comprising from about 5 mol % to about 10 mol % of the total lipid present in the LNP. In particular embodiments, the formulation is a three-component system which is phospholipid-free and comprises about 7 mol % PEG-lipid conjugate (e.g., PEG750-C-DMA), about 58 mol % cationic lipid (e.g., DLin-K-C2-DMA) or a salt thereof, and about 35 mol % cholesterol (or derivative thereof).

In other embodiments, the LNP comprising one or more nucleic acids comprises: (a) an mRNA encoding the repressor fusion protein and/or a gRNA of any of the embodiments described herein; (b) a cationic lipid or a salt thereof comprising from about 48 mol % to about 62 mol % of the total lipid present in the LNP; (c) a mixture of a phospholipid and cholesterol or a derivative thereof, wherein the phospholipid comprises about 7 mol % to about 17 mol % of the total lipid present in the LNP, and wherein the cholesterol or derivative thereof comprises about 25 mol % to about 40 mol % of the total lipid present in the LNP; and (d) a PEG-lipid conjugate comprising from about 0.5 mol % to about 3.0 mol % of the total lipid present in the LNP.

VIII. Systems and Methods for Repression of PCSK9 Target Nucleic Acids

In another aspect, the present disclosure provides systems comprising a repressor fusion protein comprising a catalytically dead CRISPR protein, and one or more gRNAs (repressor fusion protein:gRNA system), for use in repressing a target nucleic acid of a PCSK9 gene in a population of cells. The systems provided herein are useful for various applications, including as therapeutics, diagnostics, and for research. To effect the methods of the disclosure, resulting in repression or silencing of the PCSK9 gene, provided herein are programmable repressor fusion protein:gRNA systems. The programmable nature of the systems provided herein allows for the precise targeting to achieve the desired effect at one or more regions of predetermined interest in the PCSK9 gene target nucleic acid. In some embodiments, it may be desirable to reduce or eliminate expression of the PCSK9 protein in a subject comprising mutations, for example dominant mutations leading to hypercholesterolemia or familial or autosomal dominant hypercholesterolemia. In some embodiments, it may be desirable to reduce or eliminate expression of the PCSK9 protein in a subject with elevated cholesterol levels that is not the result of mutations in the PCSK9 gene.

In some embodiments, the disclosure provides systems specifically designed for use in the methods to repress or silence transcription the target nucleic acid of a PCSK9 gene in eukaryotic cells; either in vitro, ex vivo, or in vivo in a subject. Generally, any portion of the gene can be targeted using the programmable systems and methods provided herein. In one embodiment, the disclosure provides for a method of repressing a target nucleic acid sequence of a PCSK9 gene in a population of cells, the method comprising introducing into each cell of the population: i) a repressor fusion protein:gRNA system comprising a repressor fusion protein and a gRNA of any of the embodiments described herein; ii) a nucleic acid encoding the repressor fusion protein and gRNA of any of the embodiments described herein; iii) a vector selected from the group consisting of a retroviral vector, a lentiviral vector, an adenoviral vector, an adeno-associated viral (AAV) vector, and a herpes simplex virus (HSV) vector, and comprising the nucleic acid of (iv), above; v) an LNP or a synthetic nanoparticle comprising a gRNA and a mRNA encoding the repressor fusion protein; or vi) combinations of two or more of (i) to (v), wherein transcription of the target nucleic acid sequence of the cells targeted by the gRNA is repressed by the repressor fusion protein. In some embodiments of the method, contacting cells with a repressor fusion protein:gRNA system of the embodiments results in repression of the PCSK9 target nucleic acid of at least about 1%, at least about 2%, at least about 3%, at least about 4%, at least about 5%, at least about 6%, at least about 7%, at least about 8%, at least about 9%, or at least about 10%, at least about 20%, at least about 30%, at least about 40%, at least about 50%, at least about 60% or more of the cells of the population. In some embodiments of the method, the PCSK9 gene in the cells of the population is repressed or silenced such that expression of the PCSK9 protein is decreased by at least about 10%, at least about 20%, at least about 30%, at least about 40%, at least about 50%, at least about 60%, at least about 70%, at least about 80%, or at least about 90% in comparison to a cell where the PCSK9 gene has not been targeted. In some embodiments, repression of transcription of the PCSK9 gene of the cells of the population is sustained for at least about 8 hours, at least about 1 day, at least about 7 days, at least 2 weeks, at least about 3 weeks, at least about 1 month, or at least about 2 months, when assayed in an in vitro assay. In some embodiments, repression of transcription of the PCSK9 gene of the cells of the population is heritable, wherein the repression of the PCKS9 gene persists for at least 1, 2, 3, 4, 5, or 6 or more cell divisions.

In some embodiments of the method, the repression of the cell occurs in vitro. In some embodiments of the method, the repression of the cell occurs ex vivo. In some embodiments, repression occurs in vitro inside of the cell prior to introducing the cell into a subject. In some embodiments, the cell is autologous or allogeneic with respect to the subject. In some embodiments of the method, the repression of the cell occurs in vivo in a subject administered a repressor fusion protein of any of the embodiments disclosed herein. In some embodiments of the method, the cell is a eukaryotic cell. In some embodiments of the method, the eukaryotic cell is selected from the group consisting of a rodent cell, a mouse cell, a rat cell, a primate cell, and a non-human primate cell. In some embodiments of the method, the eukaryotic cell is a human cell. In some embodiments of the method, the cell is an embryonic stem cell, an induced pluripotent stem cell, a germ cell, a fibroblast, an oligodendrocyte, a glial cell, a hematopoietic stem cell, a neuron progenitor cell, a neuron, an astrocyte, a muscle cell, a bone cell, a hepatocyte, a pancreatic cell, a retinal cell, a cancer cell, a T-cell, a B-cell, an NK cell, a fetal cardiomyocyte, a myofibroblast, a mesenchymal stem cell, an autotransplanted expanded cardiomyocyte, an adipocyte, a totipotent cell, a pluripotent cell, a blood stem cell, a myoblast, a bone marrow cell, a mesenchymal cell, a parenchymal cell, an epithelial cell, an endothelial cell, a mesothelial cell, fibroblasts, osteoblasts, chondrocytes, a hematopoietic stem cell, a bone-marrow derived progenitor cell, a myocardial cell, a skeletal cell, a fetal cell, an undifferentiated cell, a multi-potent progenitor cell, a unipotent progenitor cell, a monocyte, a cardiac myoblast, a skeletal myoblast, a macrophage, a capillary endothelial cell, a xenogeneic cell, an allogenic cell, or a post-natal stem cell.

In some embodiments, the disclosure provides a method for reversing the repression of the PCSK9 gene in a population of cells resulting from the repressor fusion protein: gRNA systems. In some embodiments, the repression is reversible by introducing into cells of the population an inhibitor of DNMT. In some embodiments of the method, the repression is reversible by use of a cytidine analog inhibitor of DNMT. In some embodiments, the repression is reversible by use of an inhibitor selected from the group consisting of azacytidine, decitabine, clofarabine, and zebularine. In some embodiments, the repression is reversible by use of an inhibitor at a concentration of 0.1 μM to 40 μM, or any intermediate concentration. In some embodiments, the method comprises administrations of a therapeutically effective dose of the inhibitor of DNMT to a subject treated with a system of the disclosure, thereby reversing the repression of PCSK9 by the system.

In some embodiments, the repressor fusion protein:gRNA systems comprise a repressor fusion protein comprising a sequence of SEQ ID NOS: 3131-3132 as set forth in Table 20, or a sequence at least 60% identical, at least 70% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, or at least 99.5% identical thereto, a gRNA scaffold comprising a sequence of SEQ ID NOS: 1744-1746 or 2947-2976, or a sequence at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical thereto, and the gRNA comprises a targeting sequence of SEQ ID NOS: 1824-2944 or a sequence at least 65% identical, at least 70% identical, at least 75% identical, at least 80% identical, at least 85% identical, at least 90% identical, or at least 95% identical thereto and having between 15 and 20 amino acids. In some embodiments of the system, the gRNA comprises a targeting sequence of SEQ ID NOS: 1824-2944, as set forth in Table 7. In a particular embodiment, the repressor fusion protein of the system comprises a sequence selected from the group consisting of SEQ ID NOS: 3131-3132, the gRNA scaffold comprises a sequence selected from the group consisting of SEQ ID NOS: 1744-1746 and 2947-2976, and the targeting sequence of the gRNA of the repressor fusion protein:gRNA system is selected from the group consisting of the sequence of SEQ ID NOS: 1824-2545. In a particular embodiment, the repressor fusion protein comprises a sequence selected from the group consisting of the sequences of SEQ ID NOS: 3131-3132, the gRNA scaffold comprises a sequence selected from the group consisting of SEQ ID NOS: 1744-1746 and 2947-2976, and the targeting sequence of the gRNA is selected from the group consisting of the sequence of SEQ ID NOS: 1824-1890, 1910, 1925, 2672, 2675, 2694, and 2714 as set forth in Table 8. In a particular embodiment, wherein the systems are formulated in LNP, the repressor fusion protein comprises a sequence selected from the group consisting of SEQ ID NOS: 3131-3132, and is encoded by an mRNA, the gRNA scaffold comprises a sequence of SEQ ID NO: 1746, and the targeting sequence of the gRNA is selected from the group consisting of SEQ ID NOS: 1824-1890, 1910, 1925, 2672, 2675, 2694, and 2714.

In some embodiments, the systems comprise an mRNA comprising one or more sequences selected from the group consisting of SEQ ID NOS: 3105, 3109, and 3115-3128, or sequences at least 60% identical, at least 70% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, or at least 99.5% identical thereto. In some embodiments, the systems comprise an mRNA comprising one or more sequences selected from the group consisting of SEQ ID NOS: 3105, 3109, and 3115-3128. In a particular embodiment, the systems are formulated in LNP that encapsulate the mRNA sequence comprising one or more sequences selected from the group consisting of SEQ ID NOS: 3105, 3109, and 3115-3128, a gRNA selected from the group consisting of SEQ ID NOS: 2948-2956, 2958-2966, and 2968-2976, and the targeting sequence of the gRNA is selected from the group consisting of the sequence of SEQ ID NOS: 1824-1890, 1910, 1925, 2672, 2675, 2694, and 2714. In some embodiments, the mRNA comprises a sequence wherein at least about 70%, at least about 80%, at least about 90%, at least about 95%, at least about 99%, or 100% of uridine nucleosides of the sequence are replaced with N1-methylpseudouridine. In some embodiments, the mRNA further comprises a 5' untranslated region (UTR) and a 3' untranslated region (UTR).

In one embodiment of the method, the system is introduced into the cells using LNP comprising mRNA encoding the repressor fusion protein and gRNA variant of any of the embodiments disclosed herein. In some embodiments, the LNP comprises an mRNA encoding the repressor fusion protein comprising one or more sequences selected from the group consisting of SEQ ID NOS: 3105, 3109, and 3115-3128, or a sequence having at least about 70%, at least about 80%, at least about 85%, at least about 90%, at least about 95%, at least about 96%, at least about 97%, at least about 98%, or having at least about 99% sequence identity thereto. In some embodiments of the foregoing, the LNP comprises a gRNA variant of the disclosure having a targeting sequence complementary to the PCSK9 target nucleic acid. In some embodiments, the LNP comprises an mRNA encoding an repressor fusion protein, wherein the mRNA comprises a sequence selected from SEQ ID NOS: 3129-3130. In some embodiments, the LNP comprises gRNA variant scaffold 174 (SEQ ID NO: 1744). In some embodiments, the LNP comprises gRNA variant scaffold 235 (SEQ ID NO: 1745). In some embodiments, the LNP comprises gRNA variant scaffold 316 (SEQ ID NO: 1746). In some embodiments, the LNP comprises gRNA variant scaffold 316 with chemical modifications, including modifications set forth in the sequences of SEQ ID NOS: 2968-2976, or a sequence having at least about 70%, at least about 80%, at least about 90%, at least about 95%, at least about 96%, at least about 97%, at least about 98%, at least about 99% sequence identity thereto. In a particular embodiment, the LNP comprises an mRNA encoding a repressor fusion protein comprising the dCasX 491 (SEQ ID NO: 4) and gRNA variant 316 with chemical modifications selected from the group consisting of SEQ ID NOS: 2968-2976, or a sequence having at least about 70%, at least about 80%, at least about 90%, at least about 95%, at least about 96%, at least about 97%, at least about 98%, at least about 99% sequence identity thereto, with a linked targeting sequence selected from the group consisting of the sequences of SEQ ID NOS: 1824-2944 that are chemically modified. In a particular embodiment, the LNP comprises an mRNA encoding a repressor fusion protein comprising the dCasX 491 (SEQ ID NO: 4) and gRNA variant scaffold 316 with chemical modifications comprising the sequence of SEQ ID NO: 2968, with a linked targeting sequence selected from the group consisting of the sequences of SEQ ID NOS: 1824-2944 that are chemically modified. In some embodiments of the method, the cells to be modified are selected from the group consisting of rodent cells, mouse cells, rat cells, and non-human primate cells. In other embodiments of the method, the cells to be modified are human cells. In some embodiments of the method, the transcriptional repression of the population of cells occurs in vivo in a subject, wherein the subject is selected from the group consisting of a rodent, a mouse, a rat, a non-human primate, and a human. In some embodiments of the methods, the modified cell is a hepatocyte, or a cell of the intestine, the kidney, the central nervous system, a smooth muscle cell, macrophage or a cell of arterial walls such as the endothelium.

The LNP can be administered by a route of administration selected from the group consisting of intravenous, intraarterial, intraportal vein injection, intraperitoneal, intramuscular, intracerebroventricular, intracisternal, intrathecal, intracranial, intralumbar, intraocular, subcutaneous, and oral routes.

In some embodiments of the method of repression of a PCSK9 gene, the gene repressor systems of the present disclosure can be designed to target any region of, or proximal to, a PCSK9 gene or region of a PCSK9 gene for which repression of transcription is sought. When the entirety of the gene is to be repressed, designing a guide with a targeting sequence complementary to a sequence encompassing or proximal to the transcription start site (TSS) is contemplated by the disclosure. The TSS selection occurs at different positions within the promoter region, depending on promoter sequence and initiating-substrate concentration. The core promoter serves as a binding platform for the transcription machinery, which comprises Pol II and its associated general transcription factors (GTFs) (Haberle, V. et al. Eukaryotic core promoters and the functional basis of transcription initiation (Nat Rev Mol Cell Biol. 19(10):621 (2018)). Variability in TSS selection has been proposed to involve DNA 'scrunching' and 'anti-scrunching,' the hallmarks of which are: (i) forward and reverse movement of the RNA polymerase leading edge, but not trailing edge, relative to DNA, and (ii) expansion and contraction of the transcription bubble. In some embodiments, the target nucleic acid sequence bound by an RNP of the repressor fusion protein: gRNA system is within 1 kb of a transcription start site (TSS) of the PCSK9 gene. In some embodiments, the target nucleic acid sequence bound by an RNP of the system is within 20 bp, 50 bp, 100 bp, 150 bp, 200 bp, 250 bp, 500 bps, or 1 kb upstream of a TSS of the PCSK9 gene. In some embodiments, the target nucleic acid sequence bound by an RNP of the system is within 20 bp, 50 bp, 100 bp, 150 bp, 200 bp, 250 bp, 500 bps or 1 kb downstream of a TSS of the PCSK9 gene. In some embodiments, the target nucleic acid sequence bound by an RNP of the system is within 500 bps upstream to 500 bps downstream, or 300 bps upstream to 300 bps downstream of a TSS of the PCSK9 gene. In some embodiments, the target nucleic acid sequence bound by an RNP of the system is within 20 bp, 50 bp, 100 bp, 150 bp, 200 bp, 250 bp, 500 bps, or 1 kb of an enhancer of the PCSK9 gene. In some embodiments, the target nucleic acid sequence bound by a repressor fusion protein:gRNA RNP is within 1 kb 3' to a 5' untranslated region of the PCSK9 gene. In other embodiments, the target nucleic acid sequence bound by an RNP of the system is within the open reading frame of the PCSK9 gene, inclusive of introns (if any). In some embodiments, the targeting sequence of a gRNA of the system is designed to be specific for an exon of the PCSK9 gene. In a particular embodiment, the targeting sequence of a gRNA of the system is designed to be specific for exon 1 of the PCSK9 gene. In other embodiments, the targeting sequence of a gRNA of the system is designed to be specific for an intron of the PCSK9 gene. In other embodiments, the targeting sequence of the gRNA of the system is designed to be specific for an intron-exon junction of the PCSK9 gene. In other embodiments, the targeting sequence of the gRNA of the system is designed to be specific for a regulatory element of the PCSK9 gene. In other embodiments, the targeting sequence of the gRNA of the system is designed to be complementary to a sequence of an intergenic region of the PCSK9 gene. In other embodiments, the targeting sequence of a gRNA of the system is specific for a junction of the exon, an intron, and/or a regulatory element of the PCSK9 gene. In those cases where the targeting sequence is specific for a regulatory element, such regulatory elements include, but are not limited to promoter regions, enhancer regions, intergenic regions, 5' untranslated regions (5' UTR), 3' untranslated regions (3' UTR), conserved elements, and regions comprising cis-regulatory elements. In some embodiments, the targeting sequence of a gRNA of the system is complementary to the gene target nucleic acid sequence within 1 kb of an enhancer of the PCSK9 gene. In some embodiments, the targeting sequence of a gRNA of the system is complementary to the gene target nucleic acid sequence within the 3' untranslated region of the PCSK9 gene. The promoter region is intended to encompass nucleotides within 5 kb of the initiation point of the encoding sequence or, in the case of gene enhancer elements or conserved elements, can be thousands of bp, hundreds of thousands of bp, or even millions of bp away from the encoding sequence of the PCSK9 gene. In the foregoing, the targets are those in which the encoding PCSK9 gene is intended to be repressed and/or epigenetically modified such that the PCSK9 gene product is not expressed or is expressed at a lower level in a cell. In some embodiments, upon binding of the RNP of the system to the binding location of the target nucleic acid, the system is capable of repressing transcription of the PCSK9 gene 5' to the binding location of the RNP. In other embodiments, upon binding of the RNP of the system to the binding location of the target nucleic acid, the system is capable of repressing transcription of the PCSK9 gene 3' to the binding location of the RNP.

The systems and methods described herein can be used in a variety of cells associated with disease, e.g., cells of the liver, the intestine, the kidney, the central nervous system, smooth muscle cells, macrophages or cells of arterial walls, in which the PCSK9 gene is to be repressed or silenced. This approach, therefore, could be used for applications in a subject with a PCSK9-related disorder such as, but not limited to autosomal dominant hypercholesterolemia (ADH), hypercholesterolemia, elevated total cholesterol levels, hyperlipidemia, elevated low-density lipoprotein (LDL) levels, elevated LDL-cholesterol levels, reduced high-density lipoprotein levels, liver steatosis, coronary heart disease, ischemia, stroke, peripheral vascular disease, thrombosis, type 2 diabetes, high elevated blood pressure, atherosclerosis, obesity, Alzheimer's disease, neurodegeneration, age-related macular degeneration (AMD), or a combination thereof.

IX. Therapeutic Methods

The present disclosure provides methods of treating a PCSK9-related disease or disorder in a subject in need thereof, including but not limited to autosomal dominant hypercholesterolemia (ADH), hypercholesterolemia, elevated total cholesterol levels, elevated low-density lipoprotein (LDL) levels, reduced high-density lipoprotein levels, liver steatosis, atherosclerotic cardiovascular disease, and coronary artery disease, ischemia, stroke, peripheral vascular disease, thrombosis, type 2 diabetes, high elevated blood pressure, obesity, Alzheimer's disease, neurodegeneration, age-related macular degeneration (AMD), or a combination thereof. In some embodiments, the methods of the disclosure can prevent, treat and/or ameliorate a PCSK9-related disease or disorder of a subject by the administering to the subject of a composition of the disclosure. In some embodiments, the PCSK9-related disease is autosomal dominant hypercholesterolemia (ADH), hypercholesterolemia, elevated total cholesterol levels, hyperlipidemia, elevated low-density lipoprotein (LDL) levels, elevated LDL-cholesterol levels, reduced high-density lipoprotein levels, liver steatosis, coronary heart disease, ischemia, stroke, peripheral vascular disease, thrombosis, type 2 diabetes, high elevated blood pressure, atherosclerosis, obesity, aortic stenosis, elevated PCSK9 levels, or a combination thereof. In some embodiments, the composition administered to the subject further comprises pharmaceutically acceptable carrier, diluent or excipient.

In some cases, the PCSK9 gene of the subject to be treated by the methods of the disclosure is wild-type, but the subject nevertheless has hypercholesterolemia, elevated total cholesterol levels, hyperlipidemia, elevated low-density lipoprotein (LDL) levels, elevated LDL-cholesterol levels, reduced high-density lipoprotein levels, liver steatosis, coronary heart disease, ischemia, stroke, peripheral vascular disease, thrombosis, type 2 diabetes, high elevated blood pressure, atherosclerosis, obesity, aortic stenosis, elevated PCSK9 levels, or a combination thereof. In such cases, the methods of the disclosure can prevent, treat and/or ameliorate a PCSK9-related disease or disorder of a subject by the administering to the subject of a composition of the disclosure.

In some cases, one or both alleles of the PCSK9 gene of the subject comprises a mutation. In some cases, the PCSK9-related disease or disorder mutation is a gain of function mutation, including, but not limited to mutations encoding amino acid substitutions selected from the group consisting of S127R, D129G, F216L, D374H, and D374Y relative to the sequence of SEQ ID NO: 1823. In other cases, the PCSK9-related disorder mutation is a loss of function mutation including, but not limited to mutations encoding amino acid substitutions selected from the group consisting of R46L, G106R, Y142X, N157K, R237W and C679X relative to the sequence of SEQ ID NO: 1823.

In some embodiments, the disclosure provides methods of treating a PCSK9 or related disease or disorder in a subject in need thereof comprising repressing or silencing a PCSK9 gene in a cell of the subject, the method comprising contacting said cells with a therapeutically effective dose of: i) a repressor fusion protein:gRNA system comprising a repressor fusion protein and a gRNA; ii) a nucleic acid encoding the repressor fusion protein and gRNA of any of the embodiments described herein; iii) an LNP or a synthetic nanoparticle comprising a gRNA and a mRNA encoding the repressor fusion protein of any one of the embodiments described herein; or iv) combinations of two or more of (i) to (iii), wherein the target nucleic acid sequence of the cells targeted by the gRNA is repressed or silenced by the repressor fusion protein. In some embodiments of the method, contacting cells with a repressor fusion protein: gRNA system results in repression of the PCSK9 target nucleic acid of at least about 1%, at least about 2%, at least about 3%, at least about 4%, at least about 5%, at least about 6%, at least about 7%, at least about 8%, at least about 9%, or at least about 10%, at least about 20%, at least about 30%, at least about 40%, at least about 50%, at least about 60% or more of the cells of the targeted organ. In some embodiments of the method, the PCSK9 gene in the cells of the targeted organ are repressed such that expression of the PCSK9 protein is decreased by at least about 10%, at least about 20%, at least about 30%, at least about 40%, at least about 50%, at least about 60%, at least about 70%, at least about 80%, or at least about 90% in comparison to an untreated cell. In some embodiments of the method, contacting cells of the targeted organ with a repressor fusion protein:gRNA system results in heritable repression of the PCSK9 target nucleic acid in the cells. The cell of the treated subject can be a eukaryotic cell selected from the group consisting of a rodent cell, a mouse cell, a rat cell, a primate cell, and a non-human primate cell. In some embodiments, the eukaryotic cell of the treated subject is a human cell. In some embodiments, the cell is a cell involved in the production of LDL, including but not limited to a hepatocyte, or a cell of the intestine, the kidney, the central nervous system, a smooth muscle cell, macrophage, a retinal cell, or cell of arterial walls such as the endothelium. In some embodiments, the cell is an eye cell. In some embodiments of the methods of treating a PCSK9-related disorder in a subject, the subject is selected from the group consisting of mouse, rat, pig, non-human primate, and human.

A number of therapeutic strategies have been used to design the systems for use in the methods of treatment of a subject with a PCSK9-related disease or disorder. In some embodiments, the disclosure provides a method of treatment of a subject having a PCSK9-related disease or disorder, the method comprising administering to the subject a repressor fusion protein:gRNA composition according to a treatment regimen comprising one or more consecutive doses using a therapeutically effective dose. In some embodiments of the treatment regimen, the therapeutically effective dose of the composition is administered as a single dose. In other embodiments of the treatment regimen, the therapeutically effective dose is administered to the subject as two or more doses over a period of at least two weeks, or at least one month, or at least two months, or at least three months, or at least four months, or at least five months, or at least six months. In some embodiments of the treatment regiment, the effective doses are administered by a route selected from the group consisting of intravenous, intraportal vein injection, intraperitoneal, intramuscular, subcutaneous, intraocular, and oral routes.

In some embodiments, the disclosure provides systems of a repressor fusion protein and gRNA of any of the embodiments described herein for use in a method of treatment of a PCSK9-related disease or disorder, wherein a therapeutically effective dose of the composition is administered to a subject. In some embodiments, the composition comprises a repressor fusion protein of SEQ ID NOS: 3131-3132 as set forth in Table 20, or a sequence at least 60% identical, at least 70% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, or at least 99.5% identical thereto, the gRNA scaffold comprises a sequence selected from the group consisting of SEQ ID NOS: 1744-1746, as set forth in Table 9, and SEQ ID NOS: 2947-2976, or a sequence at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical thereto, and the gRNA comprises a targeting sequence a sequence selected from the group consisting of SEQ ID NOS: 1824-2944 or a sequence at least 65% identical, at least 70% identical, at least 75% identical, at least 80% identical, at least 85% identical, at least 90% identical, or at least 95% identical thereto and having between 15 and 20 amino acids. In some embodiments, the gRNA comprises a targeting sequence selected from the group consisting of SEQ ID NOS: 1824-1890, 1910, 1925, 2672, 2675, 2694, and 2714, or a sequence having at least about 65%, at least about 75%, at least about 80%, at least about 85%, at least about 90%, or at least about 95% identity thereto.

In some embodiments, the composition is administered in an LNP formulation. In some embodiments, the disclosure provides repressor fusion proteins and gRNA compositions for use in the manufacture of a medicament for use in the treatment of a PCSK9-related disease or disorder in a subject wherein repression of a PCSK9 leads to the amelioration of the disease or prevention of symptoms or clinical findings associated with the disease or disorder.

In some embodiments, the administering to a subject with a PCSK9-related disease or disorder of the therapeutically effective amount of the repressor fusion protein:gRNA modality, to repress or silence expression of PCSK9, leads to the prevention or amelioration of the underlying PCSK9-related disorder or disorder such that an improvement is observed in the subject, notwithstanding that the subject may still be afflicted with the underlying disorder. In some embodiments, the repressor fusion protein:gRNA modality comprises LNP comprising a gRNA and an mRNA encoding a repressor fusion protein and a guide ribonucleic acid disclosed herein. In some embodiments, the administration of the therapeutically effective amount of the repressor fusion protein:gRNA modality leads to an improvement in at least one clinically-relevant endpoint including, but not limited to percent change from baseline in LDL-cholesterol, decrease in plaque atheroma volume, reduction in in coronary plaque, reduction in atherosclerotic cardiovascular disease (ASCVD), cardiovascular death, nonfatal myocardial infarction, ischemic stroke, nonfatal stroke, coronary revascularization, unstable angina, or visual acuity. In some embodiments, the administration of the therapeutically effective amount of the repressor fusion protein:gRNA modality leads to an improvement in at least two clinically-relevant endpoints. In some embodiments, the subject is selected from mouse, rat, pig, dog, non-human primate, and human. In some embodiments, the subject is human.

In some embodiments, the methods of treatment further comprise administering a chemotherapeutic agent wherein the agent is effective in lowering LDL levels. Such agents include, but are not limited to, statins, niacin, fibrates, or anti-PCSK9 antibody drugs.

Methods of obtaining samples from treated subjects for analysis to determine the effectiveness of the treatment, such as body fluids or tissues, and methods of preparation of the samples to allow for analysis are well known to those skilled in the art. Methods for analysis of RNA and protein levels are discussed above and are well known to those skilled in the art. The effects of treatment can also be assessed by measuring biomarkers associated with the PCSK9 gene expression in the aforementioned fluids, tissues or organs, collected from an animal contacted with one or more compounds of the disclosure, by routine clinical methods known in the art. Biomarkers of PCSK9 disorders include, but are not limited to, PCSK9 levels, low-density lipoprotein (LDL-cholesterol), apolipoprotein B, non-HDL cholesterol, triglycerides and lipoprotein a, soluble CD40 ligand, ostcopontin (OPN), osteoprotegerin (OPG), matrix metalloproteinases (MMP) and myeloperoxidase (MPOP), wherein the concentration of the marker is compared to concentrations known to be physiologically normal or in subjects not having a PCSK9 disorder.

Several mouse models expressing mutant forms of PCSK9 exist and are suitable for evaluating the methods of treatment. Transgenic mouse models of PCSK9-related disorders include knock-in mouse models having hPCSK9 (Carreras, A. In vivo genome and base editing of a human PCSK9 knock-in hypercholesterolemic mouse model. MC Biology 17:4 (2019); Herbert B., et al. Increased secretion of lipoproteins in transgenic mice expressing human D374Y PCSK9 under physiological genetic control. Arterioscler Thromb Vasc Biol. 30(7):1333 (2010)).

In some embodiments, the method of treating a PCSK9-related disease or disorder in a subject comprises pretreating the subject with a therapeutic agent that increases hepatic LDL receptor (LDLR) expression. In some embodiments, the therapeutic agent is a PCSK9 inhibitor, such as a monoclonal antibody, nucleic acid-based agent, or a small molecule. Exemplary therapeutic agents include, but are not limited to, evolocumab, inclisiran, alirocumab, and MK-0616. Without wishing to be bound by theory or mechanism, it is believed that the pretreatment with an inhibitor of PCSK9, may lead to an increase in hepatic LDL receptor (LDLR) expression that, in turn, may facilitate the uptake of the LNP comprising the CasX:gRNA composition that is subsequently administered to the subject. By increasing the hepatic cell uptake of the LNP, it is expected that editing of the PCSK9 gene will be enhanced such that an improvement in the PCSK9-related disorder would be attained.

X. Pharmaceutical Compositions, Kits, and Articles of Manufacture

In some embodiments, the disclosure provides pharmaceutical compositions comprising: i) a repressor fusion protein and a gRNA of the disclosure comprising a targeting sequence specific for a PCSK9 gene; ii) one or more nucleic acids encoding the repressor and the gRNA of (i); iii) an LNP or synthetic nanoparticle comprising a gRNA and an mRNA encoding a repressor fusion protein, together with one or more pharmaceutically suitable excipients. In some embodiments, the pharmaceutical composition is formulated for a route of administration selected from the group consisting of intravenous, intraportal vein injection, intraperitoneal, intramuscular, subcutaneous, intraocular, and oral routes. In one embodiment, the pharmaceutical composition is in a liquid form or a frozen form. In another embodiment, the pharmaceutical composition is in a pre-filled syringe for a single injection. In another embodiment, the pharmaceutical composition is in solid form, for example the pharmaceutical composition is lyophilized.

In other embodiments, provided herein are kits comprising a repressor fusion protein and one or a plurality of CasX gRNA of any of the embodiments of the disclosure comprising a targeting sequence specific for a PCSK9 gene and a suitable container (for example a tube, vial or plate).

In other embodiments, provided herein are kits comprising an LNP formulation encapsulating an mRNA encoding a repressor fusion protein and one or a plurality of CasX gRNA of any of the embodiments of the disclosure comprising a targeting sequence specific for a PCSK9 gene, and a suitable container (for example a tube, vial or plate). In exemplary embodiments, a kit of the disclosure comprises any one of the repressor fusion proteins disclosed herein and a gRNA scaffold of any one of SEQ ID NOS: 1744-1746 and 2947-2976.

In some embodiments, the kit comprises a gRNA or a vector encoding a gRNA, wherein the gRNA comprises a scaffold sequence selected from the group consisting of SEQ ID NOS: 1744-1746 and 2947-2976, and a targeting sequence selected from the group consisting of SEQ ID NOS: 1824-2944 as set forth in Table 7. In some embodiments, the gRNA scaffold comprises a sequence selected from the group consisting of SEQ ID NOS: 2948-2956, 2958-2966, and 2968-2976, and a targeting sequence selected from the group consisting of SEQ ID NOS: 1824-2944 as set forth in Table 7. In some embodiments, the gRNA scaffold comprises a sequence selected from the group consisting of SEQ ID NOS: 2948-2956, 2958-2966, and 2968-2976, and a targeting selected from the group consisting of the sequences of SEQ ID NOs: 1824-1890, 1910, 1925, 2672, 2675, 2694, and 2714.

In certain embodiments, provided herein are kits comprising a repressor fusion protein and gRNA repressor pair comprising any one of the repressor fusion proteins disclosed herein, and a gRNA variant comprising a scaffold sequence selected from the group consisting of SEQ ID NOS: 1744-1746 as set forth in Table 9 and a targeting sequence selected from the group consisting of SEQ ID NOS: 1824-2944 as set forth in Table 7. In some embodiments, the gRNA of the gene repression pair comprises a scaffold sequence selected from the group consisting of SEQ ID NOS: 2947-2976 and a targeting sequence of any one of SEQ ID NOS: 1824-2944 as set forth in Table 7. In some embodiments, the gRNA of the gene repression pair comprises a scaffold sequence selected from the group consisting of SEQ ID NOS: 2948-2956, 2958-2966, and 2968-2976, and a targeting selected from the group consisting of the sequences of SEQ ID NOs: 1824-1890, 1910, 1925, 2672, 2675, 2694, and 2714.

In some embodiments, the kit further comprises a buffer, a nuclease inhibitor, a protease inhibitor, a liposome, a therapeutic agent, a label, a label visualization reagent, instructions for use, or any combination of the foregoing. In some embodiments, the kit further comprises a pharmaceutically acceptable carrier, diluent or excipient.

In some embodiments, the kit comprises appropriate control compositions for gene repression applications, and instructions for use.

In some embodiments, the kit comprises a vector comprising a sequence encoding a repressor fusion protein of the disclosure and a CasX gRNA of the disclosure.

The following Examples are merely illustrative and are not meant to limit any aspects of the present disclosure in any way.

EXAMPLES

Example 1: Use of Repressor Fusion Proteins to Repress PCSK9 in Human Cells

Fusing chromatin remodelers and DNA methyltransferases to CasX to reduce expression of target genes is an alternative approach to conventional gene editing for reducing expression of proteins associated with certain diseases and disorders. Experiments were performed to transiently express long-term repressor proteins (LTRPs, also referred to interchangeably herein as repressor fusion proteins) in HepG2 cells to reduce PCSK9 levels without the use of permanent genome editing.

Materials and Methods

Spacer (also referred to as targeting sequence) design: Spacers 1 KB upstream of the PCSK9 promoter and through PCSK9 Exon 1 were chosen manually based on availability of TTC PAM sequences. Spacers in Intron 1, Exon 5, and Intron 5 were selected based on the availability of TTC PAMs in regions identified as hypomethylated in human livers.

Lentiviral plasmid constructs comprising sequences encoding an LTRP protein having the #1 configuration (as diagrammed in FIG. 1), guide scaffold variant 174, and the PCSK9-targeting spacers listed in Table 10 were generated using standard molecular cloning techniques. Cloned and sequence-validated constructs were midi-prepped and subjected to quality assessment prior to transfection into HepG2 cells. Plasmid constructs were transfected using Viafect transfection reagent according to the manufacturer's instructions.

HepG2s were grown in DMEM F/12 media supplemented with 10% FBS and 1% Pen/Strep and were kept in the growth phase.

mRNA was isolated using Zymo Quick-RNA™ kit and Reverse Transcription was performed using Thermo High-Capacity RNA-to-cDNA™ Kit according to the manufacturer instructions.

Secreted PCSK9 and human serum albumin levels were assessed via PerkinElmer®/Cisbio cat #63ADK050PEH and HSA ELISA: Perkin Elmer/Cisbio cat #6FHSAPEG respectively.

TABLE 10

Sequences of LTRP-specific spacers targeting the human PCSK9 locus.

| Spacer ID | PAM | Spacer DNA sequence | SEQ ID NO: | Spacer RNA sequence | SEQ ID NO: | Targeting region |
|---|---|---|---|---|---|---|
| 6.1 | TTC | GAGGAGGACGGCCTGGCCGA | 2977 | GAGGAGGACGGCCUGGCCGA | 1834 | Exon 1 |
| 6.4 | TTC | GCCAGGCCGTCCTCCTCGGA | 2978 | GCCAGGCCGUCCUCCUCGGA | 1836 | Exon 1 |
| 6.5 | TTC | GTGCTCGGGTGCTTCGGCCA | 2979 | GUGCUCGGGUGCUUCGGCCA | 1837 | Exon 1 |
| 6.112 | TTC | CTTGGCAGTTGAGCACGCGC | 2980 | CUUGGCAGUUGAGCACGCGC | 2223 | Exon 5 |
| 6.117 | TTC | ACTTTGTTTGCAAAGACCTC | 2981 | ACUUUGUUUGCAAAGACCUC | 1838 | Promoter |
| 6.118 | TTC | GAGTGAAATGGCCTGCTCTG | 2982 | GAGUGAAAUGGCCUGCUCUG | 1839 | Promoter |
| 6.119 | TTC | GAGCAGGCCATTTCACTCGG | 2983 | GAGCAGGCCAUUUCACUCGG | 1840 | Promoter |
| 6.120 | TTC | CTCGGAATCTGCTGTGCATC | 2984 | CUCGGAAUCUGCUGUGCAUC | 1841 | Promoter |
| 6.121 | TTC | GGAAGGGCTGTCGATACTGG | 2985 | GGAAGGGCUGUCGAUACUGG | 1842 | Promoter |

TABLE 10-continued

Sequences of LTRP-specific spacers targeting the human PCSK9 locus.

| Spacer ID | PAM | Spacer DNA sequence | SEQ ID NO: | Spacer RNA sequence | SEQ ID NO: | Targeting region |
|---|---|---|---|---|---|---|
| 6.122 | TTC | CCTTTGTTTCTTCCCAGTAT | 2986 | CCUUUGUUUCUUCCCAGUAU | 1883 | Promoter |
| 6.123 | TTC | TCCCAGTATCGACAGCCCTT | 2987 | UCCCAGUAUCGACAGCCCUU | 1843 | Promoter |
| 6.124 | TTC | CAGTATCGACAGCCCTTCCA | 2988 | CAGUAUCGACAGCCCUUCCA | 1844 | Promoter |
| 6.125 | TTC | AGAAAGAGCAAGCCTCATGT | 2989 | AGAAAGAGCAAGCCUCAUGU | 1845 | Promoter |
| 6.126 | TTC | CCTTTTCATCCTCCTGCCTG | 2990 | CCUUUUCAUCCUCCUGCCUG | 2672 | Promoter |
| 6.127 | TTC | TCCTCCTGCCTGGTACACAA | 2991 | UCCUCCUGCCUGGUACACAA | 1884 | Promoter |
| 6.128 | TTC | AGAAATCAACTGGACAAGCA | 2992 | AGAAAUCAACUGGACAAGCA | 1846 | Promoter |
| 6.129 | TTC | TTTTACACACCATGTTCAAG | 2993 | UUUUACACACCAUGUUCAAG | 2675 | Promoter |
| 6.130 | TTC | ATTTGCAAAGATTCCTTTTA | 2994 | AUUUGCAAAGAUUCCUUUUA | 2677 | Promoter |
| 6.131 | TTC | TGAACATGGTGTGTAAAAGG | 2995 | UGAACAUGGUGUGUAAAAGG | 1847 | Promoter |
| 6.132 | TTC | AGAAGATTCAATTTGCAAAG | 2996 | AGAAGAUUCAAUUUGCAAAG | 1848 | Promoter |
| 6.133 | TTC | ATGGTAGGCACAAGCTCAGC | 2997 | AUGGUAGGCACAAGCUCAGC | 1849 | Promoter |
| 6.134 | TTC | GAATTCTATGGTAGGCACAA | 2998 | GAAUUCUAUGGUAGGCACAA | 1850 | Promoter |
| 6.135 | TTC | GGAAAGCTGAGCTTGTGCCT | 2999 | GGAAAGCUGAGCUUGUGCCU | 1851 | Promoter |
| 6.136 | TTC | GGTTTTAAGTTTGCAAAGAC | 3000 | GGUUUUAAGUUUGCAAAGAC | 2683 | Promoter |
| 6.137 | TTC | GAATGTACCTATATGACGTC | 3001 | GAAUGUACCUAUAUGACGUC | 1885 | Promoter |
| 6.138 | TTC | AGGGATTTATACTACAAAGA | 3002 | AGGGAUUUAUACUACAAAGA | 1852 | Promoter |
| 6.139 | TTC | AGGAGCAGCTAGTTGGTAAG | 3003 | AGGAGCAGCUAGUUGGUAAG | 1853 | Promoter |
| 6.140 | TTC | AAACTTAGCCTGGACCCCCT | 3004 | AAACUUAGCCUGGACCCCCU | 1854 | Promoter |
| 6.141 | TTC | ACTGGCCTTAACCTGGCAGC | 3005 | ACUGGCCUUAACCUGGCAGC | 1855 | Promoter |
| 6.142 | TTC | TTCCACTGGCCTTAACCTGG | 3006 | UUCCACUGGCCUUAACCUGG | 1856 | Promoter |
| 6.143 | TTC | GAATCAATCCTACTGTGGAC | 3007 | GAAUCAAUCCUACUGUGGAC | 1857 | Promoter |
| 6.144 | TTC | GTGGGCAGCGAGGAGTCCAC | 3008 | GUGGGCAGCGAGGAGUCCAC | 1858 | Promoter |
| 6.145 | TTC | TGGGTCCACCTTGTCTCCTG | 3009 | UGGGUCCACCUUGUCUCCUG | 1859 | Promoter |
| 6.146 | TTC | GAAGTCTCACTGGTCAGCAG | 3010 | GAAGUCUCACUGGUCAGCAG | 1860 | Promoter |
| 6.147 | TTC | GTGTTTCCTGGGTCCACCTT | 3011 | GUGUUUCCUGGGUCCACCUU | 1861 | Promoter |
| 6.148 | TTC | GCCGGGCCCACCTTTTCAGT | 3012 | GCCGGGCCCACCUUUUCAGU | 2694 | Promoter |
| 6.149 | TTC | AGCCCAGTTAGGATTTGGGA | 3013 | AGCCCAGUUAGGAUUUGGGA | 1862 | Promoter |
| 6.150 | TTC | TCCCTCTGCGCGTAATCTGA | 3014 | UCCCUCUGCGCGUAAUCUGA | 1863 | Promoter |
| 6.151 | TTC | CTCTGCGCGTAATCTGACGC | 3015 | CUCUGCGCGUAAUCUGACGC | 1864 | Promoter |
| 6.152 | TTC | GCCTCGCCCTCCCCAAACAG | 3016 | GCCUCGCCCUCCCCAAACAG | 1865 | Promoter |
| 6.153 | TTC | GTTAATGTTTAATCAGATAG | 3017 | GUUAAUGUUUAAUCAGAUAG | 1866 | Promoter |
| 6.154 | TTC | AGGGTGTGGGTGCTTGACGC | 3018 | AGGGUGUGGGUGCUUGACGC | 1867 | Promoter |
| 6.155 | TTC | GCAGCGACGTCGAGGCGCTC | 3019 | GCAGCGACGUCGAGGCGCUC | 1868 | Exon 1 |
| 6.156 | TTC | GTTCAGGGTCTGAGCCTGGA | 3020 | GUUCAGGGUCUGAGCCUGGA | 2702 | Exon 1 |
| 6.157 | TTC | GGGTCTGAGCCTGGAGGAGT | 3021 | GGGUCUGAGCCUGGAGGAGU | 1869 | Exon 1 |
| 6.158 | TTC | GGAGCAGGGCGCGTGAAGGG | 3022 | GGAGCAGGGCGCGUGAAGGG | 1870 | Exon 1 |

TABLE 10-continued

Sequences of LTRP-specific spacers targeting the human PCSK9 locus.

| Spacer ID | PAM | Spacer DNA sequence | SEQ ID NO: | Spacer RNA sequence | SEQ ID NO: | Targeting region |
|---|---|---|---|---|---|---|
| 6.159 | TTC | GCGCGCCCCTTCACGCGCCC | 3023 | GCGCGCCCCUUCACGCGCCC | 1871 | Exon 1 |
| 6.160 | TTC | CGCGCCCTGCTCCTGAACTT | 3024 | CGCGCCCUGCUCCUGAACUU | 1872 | Exon 1 |
| 6.161 | TTC | GCTCCTGCACAGTCCTCCCC | 3025 | GCUCCUGCACAGUCCUCCCC | 1873 | Exon 1 |
| 6.167 | TTC | CACTGAATAGCGCAGCCGCA | 3026 | CACUGAAUAGCGCAGCCGCA | 1874 | Intron 1 |
| 6.168 | TTC | GTGGGAAGGTTCGCGGGGTT | 3027 | GUGGGAAGGUUCGCGGGGUU | 1875 | Intron 1 |
| 6.169 | TTC | CGGGGTTGGGAGACCCGGAG | 3028 | CGGGGUUGGGAGACCCGGAG | 1876 | Intron 1 |
| 6.170 | TTC | TCGGCCTCCGGGTCTCCCAA | 3029 | UCGGCCUCCGGGUCUCCCAA | 1877 | Intron 1 |
| 6.171 | TTC | CAGTACGTTCCAGGCATTCA | 3030 | CAGUACGUUCCAGGCAUUCA | 1878 | Intron 1 |
| 6.172 | TTC | GCTGAAACAGATGGAATACT | 3031 | GCUGAAACAGAUGGAAUACU | 1879 | Intron 1 |
| 6.173 | TTC | ATCTGTTTCAGCCGAAGAAA | 3032 | AUCUGUUUCAGCCGAAGAAA | 1922 | Intron 1 |
| 6.174 | TTC | TTTCTTCGGCTGAAACAGAT | 3033 | UUUCUUCGGCUGAAACAGAU | 1923 | Intron 1 |
| 6.175 | TTC | GCCGAAGAAAAGAACCAGCT | 3034 | GCCGAAGAAAAGAACCAGCU | 1924 | Intron 1 |
| 6.176 | TTC | CGAGGCCCATTGGCGTCCTT | 3035 | CGAGGCCCAUUGGCGUCCUU | 1926 | Intron 1 |
| 6.177 | TTC | TCTCACTAGCTGTGGTGCTT | 3036 | UCUCACUAGCUGUGGUGCUU | 1934 | Intron 1 |
| 6.178 | TTC | GTTGACCATGAGTGAACTTA | 3037 | GUUGACCAUGAGUGAACUUA | 1938 | Intron 1 |
| 6.179 | TTC | CTGGCTCTGCGGCAGAGGCT | 3038 | CUGGCUCUGCGGCAGAGGCU | 2225 | Intron 5 |
| 6.180 | TTC | TCTGCACTCGTGGCCACTGG | 3039 | UCUGCACUCGUGGCCACUGG | 2226 | Intron 5 |
| 6.181 | TTC | TCATCTGCACTCGTGGCCAC | 3040 | UCAUCUGCACUCGUGGCCAC | 2228 | Intron 5 |
| 6.182 | TTC | AGACTGTGACTACATTTAGT | 3041 | AGACUGUGACUACAUUUAGU | 2235 | Intron 5 |
| 6.183 | TTC | TCAACTATTTAGCAGCTACG | 3042 | UCAACUAUUUAGCAGCUACG | 2240 | Intron 5 |
| 6.184 | TTC | CAGCGAGTTCCCCAGCTTGA | 3043 | CAGCGAGUUCCCCAGCUUGA | 2242 | Intron 5 |
| 6.185 | TTC | GCCCTGAGACTTTCCTACAG | 3044 | GCCCUGAGACUUUCCUACAG | 2246 | Intron 5 |
| 6.186 | TTC | GCCCCATCAGGTGACCCCTT | 3045 | GCCCCAUCAGGUGACCCCUU | 2248 | Intron 5 |
| 6.187 | TTC | GGAACTGACCTGACTGAGCC | 3046 | GGAACUGACCUGACUGAGCC | 2249 | Intron 5 |

Results

Figure 3:
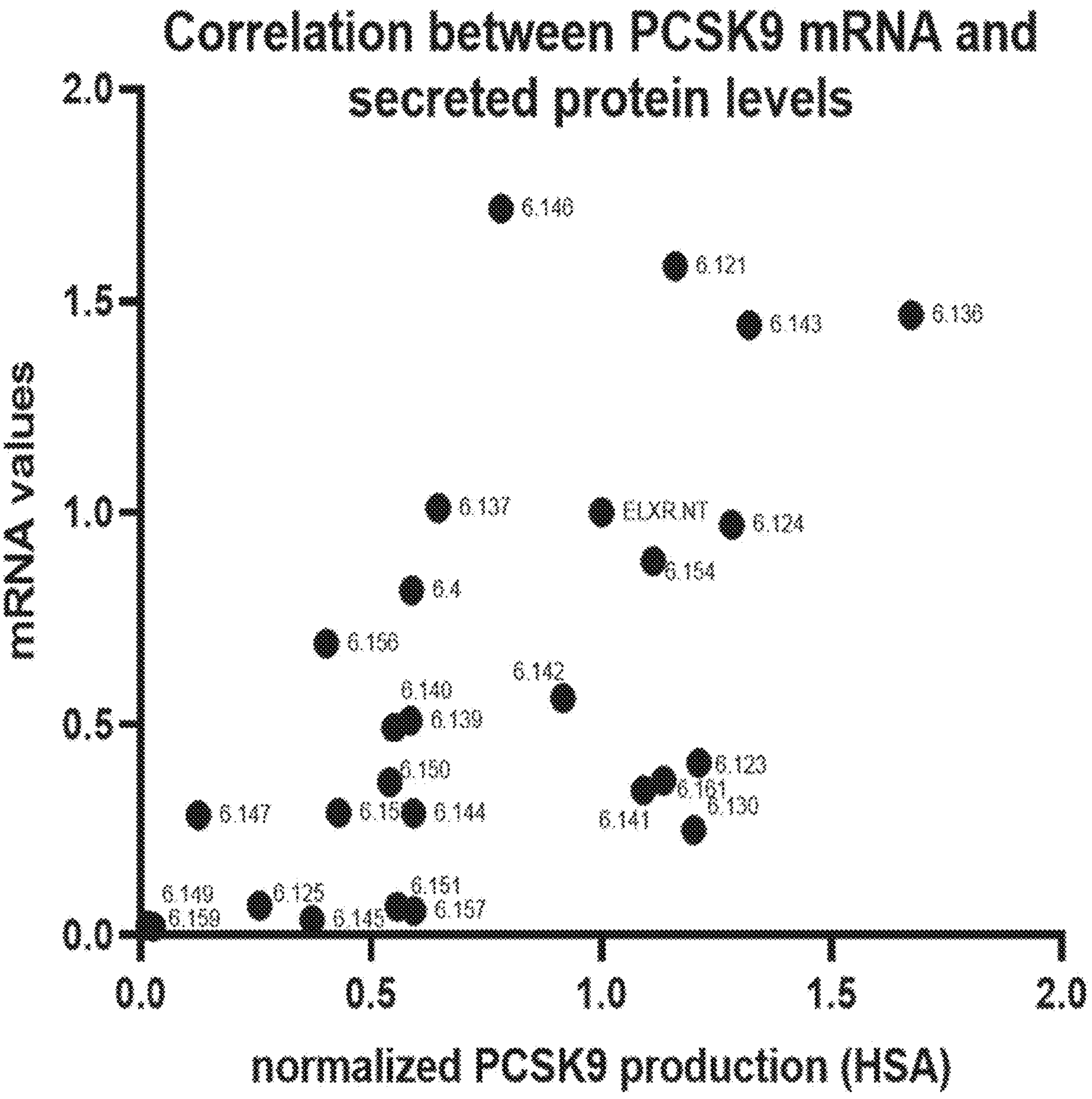
FIG. 3 is a dot plot graph showing the correlation between secreted PCSK9 protein and PCSK9 mRNA levels in human hepatocytes that were transiently transfected with LTRPs, as described in Example 1. PCSK9 mRNA levels were normalized to the housekeeping gene RPLP0. Secreted PCSK9 protein levels were normalized to secreted human serum albumin (HSA). Samples were normalized to a non-targeting (NT) control.

HepG2 cells were transiently transfected with LTRP fusion proteins in configuration #1 with the targeting spacers listed in Table 10 and were subsequently selected with puromycin. Puromycin-resistant cells were allowed to expand in culture. After 4 weeks of culture, the media was collected to measure secreted PCSK9 levels, and mRNA was analyzed. Secreted PCSK9 levels were normalized to secreted human serum albumin to control for differences in cell number in different wells, and the results are presented as dot plots in FIG. 3. Compared to the non-targeting (NT) control, ~60% of the constructs demonstrated reduction of PCSK9 mRNA and protein levels, while ~20% of constructs repressed PCSK9 by greater than 50%.

Example 2: Demonstration that Use of LTRP Fusion Proteins can Induce Silencing of the Endogenous PCSK9 Locus in Mouse Hepa 1-6 Cells Experiments were performed to demonstrate the ability of LTRP fusion proteins to induce durable repression of the endogenous PCSK9 locus in mouse Hepa1-6 liver cells, when delivered as mRNA co-transfected with a targeting gRNA.

Materials and Methods

Experiment #1: DXR1 Vs. LTRP #1 in Hepa1-6 Cells when Delivered as mRNA

Generation of dXR1 and LTRP #1 mRNA:

mRNA encoding dXR1, a dCasX fused to a ZIM3-KRAB domain, or LTRP #1 (configuration #1 in FIG. 1) containing the ZIM3-KRAB (hereafter known as dXR1 and LTRP1-

ZIM3 respectively) domain was generated by in vitro transcription (IVT) either in-house or via a third-party. Briefly, constructs encoding for a 5'UTR region, dXR1 or LTRP1-ZIM3 harboring the ZIM3-KRAB domain with flanking SV40 NLSes, and a 3'UTR region were generated and cloned into a plasmid containing a T7 promoter and 80-nucleotide poly(A) tail. These constructs also contained a 2x FLAG sequence. Sequences encoding the dXR1 and LTRP1-ZIM3 molecules were codon-optimized using a codon utilization table, in addition to using a publicly available codon optimization tool and adjusting parameters such as GC content as needed. For in-house in vitro transcription (IVT), the resulting plasmid was linearized prior to use for IVT reactions, which were carried out with CleanCap® AG and N1-methyl-pseudouridine. IVT reactions were then subjected to DNase digestion and oligodT purification on-column. For experiment #1, the DNA sequences encoding the dXR1 and LTRP1-ZIM3 molecules are listed in Table 11. The corresponding mRNA sequences encoding the dXR1 and LTRP1-ZIM3 mRNAs are listed in Table 12. The protein sequences of the dXR1 and LTRP1-ZIM3 are shown in Table 13.

TABLE 11

Encoding sequences of the dXR1 and LTRP1-ZIM3 mRNA molecules assessed in experiment #1 of this example *.

| dXR or LTRP ID | Component | DNA sequence or SEQ ID NO: |
|---|---|---|
| dXR1 (codon-optimized) | 5'UTR | 3047 |
| | START codon + NLS + linker | 3048 |
| | dCasX491 | 3049 |
| | Linker + buffer sequence | 3050 |
| | ZIM3-KRAB | 3051 |
| | Buffer sequence + NLS | 3052 |
| | Tag | 3053 |
| | STOP codon + buffer sequence | 3054 |
| | 3'UTR | 3055 |
| | Buffer sequence | TCTAG |
| | Poly(A) tail | 3057 |
| LTRP #1 (codon-optimized) | 5'UTR | 3047 |
| | START codon + NLS + buffer sequence + linker | 3058 |
| | START codon + DNMT3A catalytic domain | 3059 |
| | Linker | 3060 |
| | DNMT3L interaction domain | 3061 |
| | Linker | 3062 |
| | dCasX491 | 3049 |
| | Linker | 3050 |
| | ZIM3-KRAB | 3051 |
| | Buffer sequence + NLS | 3052 |
| | Tag | 3053 |
| | STOP codons + buffer sequence | 3054 |
| | 3'UTR | 3055 |
| | Buffer sequence | TCTAG |
| | Poly(A) tail | 3057 |

*Components are listed in a 5' to 3' order within the constructs

TABLE 12

Full-length RNA sequences of dXR1 and LTRP1-ZIM3 mRNA molecules assessed in experiment #1 of this example. Modification 'mψ' = N1-methyl-pseudouridine.

| dXR or LTRP ID | SEQ ID NO | RNA Sequence |
|---|---|---|
| dXR1 | 3063 | AAAmψAAGAGAGAAAAGAAGAGmψAAGAAGAAAmψAmψAAGAGCCACCAmψGGCCCCm<br>ψAAGAAGAAGCGmψAAAGmψGAGCCGGGGCGGCAGCGGCGGCGGCAGCGCCCAGGAGA<br>mψmψAAACGGAmψCAACAAGAmψCAGAAGAAGACmψmψGmψGAAAGACAGCAACACCA<br>AGAAGGCCGGCAAGACAGGCCCCAmψGAAAACCCmψGCmψGGmψmψAGAGmψGAmψGA<br>CACCCGAmψCmψGAGAGAGCGGCmψGGAAAACCmψGAGAAAGAAGCCmψGAAAAmψAm<br>ψCCCCCAGCCCAmψCAGCAAmψACAmψCmψAGAGCCAACCmψGAAmψAAGCmψGCmψG<br>ACCGAmψmψACACCGAAAmψGAAGAAGGCGAmψCCmψGCAmψGmψGmψACmψGGGAAG<br>AGmψmψCCAGAAGGACCCmψGmψGGGCCmψGAmψGAGCCGGGmψGGCCCAGCCmψGCC<br>AGCAAGAAGAmψCGAmψCAGAACAAGCmψGAAACCmψGAGAmψGGACGAGAAGGGCAA<br>CCmψGACCACCGCCGGCmψmψmψGCCmψGcmψCmψCAGmψGmψGGCCAGCCCCmψGmψ<br>mψCGmψGmψACAAGCmψGGAGCAGGmψGmψCmψGAGAAGGGCAAGGCmψmψACACCAA<br>CmψACmψmψCGGACGGmψGCAAmψGmψGGCCGAGCACGAAAAGCmψGAmψCCmψGCmψ<br>GGCCCAGCmψGAAGCCCGAGAAGGAmψAGCGACGAAGCCGmψGACAmψAmψAGCCmψG<br>GGAAAGmψmψmψGGGCAGAGGGCCCmψGGAmψmψmψCmψACAGCAmψmψCAmψGmψGA<br>CCAAGGAGmψCCACCCACCCCGmψGAAGCCCCmψGGCCCAGAmψCGCCGGAAACAGAm<br>ψACGCCmψCCGGACCmψGmψGGGAAAGGCCCmψGAGCGACGCAmψGmψAmψGGGCACA<br>AmψCGCCmψCCmψmψCCmψGmψCmψAAGmψACCAGGACAmψCAmψCAmψCGAACACCA |

TABLE 12-continued

Full-length RNA sequences of dXR1 and LTRP1-ZIM3 mRNA molecules assessed in experiment #1 of this example. Modification 'mψ' = N1-methyl-pseudouridine.

| dXR or LTRP ID | SEQ ID NO | RNA Sequence |
|---|---|---|
| | | GAAGGmψGGmψGAAGGGCAACCAGAAGAGACmψGGAGAGCCmψGCGGGAGCmψGGCCG<br>GCAAGGAAAACCmψGGAAmψACCCmψAGCGmψGACCCmψGCCACCmψCAGCCmψCACA<br>CCAAGGAGGGCGmψmψGAmψGCCmψACAACGAAGmψGAmψCGCCCGGGmψGCGAAmψG<br>mψGGGmψGAACCmψGAACCmψGmψGGCAGAAGCmψGAAGCmψAAGCAGAGAmψGAmψG<br>CCAAGCCmψCmψGCmψGAGACmψGAAGGGAmψmψCCCmψmψCCmψmψmψCCmψCmψGG<br>mψCGAGAGACAGGCCAACGAAGmψGGACmψGGmψGGGACAmψGGmψGmψGmψAACGmψ<br>GAAGAAGCmψGAmψCAACGAGAAAAAGGAGGAmψGGCAAGGmψGmψmψmψmψGGCAGA<br>AmψCmψGGCmψGGCmψACAAGAGACAGGAAGCCCmψGAGACCAmψACCmψGAGCAGCG<br>AGGAAGAmψCGGAAGAAGGGAAAGAAAmψmψCGCmψCGGmψACCAGCmψGGGCGACCm<br>ψGCmψGCmψGCACCmψGGAAAAGAAGCACGGCGAGGACmψGGGGAAAGGmψGmψACGA<br>CGAGGCCmψGGGAGCGGAmψmψGACAAGAAAGmψGGAAGGCCmψGAGCAAGCACAmψC<br>AAGCmψGGAAGAGGAACGGAGAAGCGAGGACGCCCAGAGCAAGGCCGCCCmψGACCGA<br>CmψGGCmψGCGGGCmψAAGGCCAGCmψmψCGmψGAmψCGAGGGCCmψGAAGGAGGCCG<br>ACAAGGACGAGmψmψCmψGCAGAmψGCGAGCmψGAAGCmψGCAGAAGmψGGmψACGGG<br>GACCmψGCGGGGAAAGCCCmψmψCGCCAmψCGAAGCCGAGAACAGCAmψCCmψGGACA<br>mψCAGCGGCmψmψCAGCAAGCAGmψACAACmψGmψGCCmψmψCAmψCmψGGCAGAAGG<br>ACGGCGmψGAAGAAGCmψGAACCmψGmψACCmψGAmψCAmψCAACmψACmψmψCAAGG<br>GCGGCAAGCmψGCGGmψmψCAAGAAGAmψCAAACCmψGAAGCCmψmψCGAAGCCAACA<br>GamψmψCmψACACCGmψGAmψCAACAAAAAGAGCGGCGAGAmψCGmψGCCCAmψGGAG<br>GmψGAACmψmψCAACmψmψCGACGACCCCAACCmψGAmψCAmψCCmψGCCmψCmψGGC<br>CmψmψmψGGCAAGAGACAGGGCAGAGAAmψmψCAmψCmψGGAACGACCmψGCmψGmψC<br>CCmψGGAAACCGGCAGCCmψGAAGCmψGGCCAACGGAAGAGmψGAmψCGAGAAGACAC<br>mψGmψACAACAGAAGAACCCGGCAGGAmψGAGCCmψGCCCmψGmψmψCGmψGGCCCmψ<br>GACCmψmψCGAGCGGCGGGAGGmψCCmψGGACmψCCmψCCAAmψAmψCAAACCAAmψG<br>AACCmψGAmψCGGCGmψGGCAAGAGGCGAAAACAmψCCCCGCCGmψGAmψCGCCCmψG<br>ACCGACCCCGAGGGCmψGCCCACmψGAGCCGGmψmψmψAAGGAmψAGCCmψGGGAAAC<br>CCAACCCACAmψCCmψGAGAAmψCGGCGAGAGCmψAmψAAGGAGAAGCAGCGGACCAm<br>ψCCAGGCCAAGAAGGAGGmψGGAGCAGCGGAGAGCCGGCGGCmψACAGCCGGAAGmψA<br>CGCCAGCAAAGCCAAGAAmψCmψGGCAGACGAmψAmψGGmψGAGAAACACCGCmψAGA<br>GAmψCmψGCmψGmψACmψACGCCGmψGACCCAGGAmψGCCAmψGCmψGAmψCmψmψCG<br>CCAACCmψGAGCCGGGGCmψmψCGGCCGGCAGGGCAAGCGGACCmψmψCAmψGGCCGA<br>GAGACAGmψACACACGGAmψGGAGGACmψGGCmψGACCGCCAAGCmψGGCCmψACGAG<br>GGCCmψGAGCAAGACCmψACCmψGmψCCAAGACACmψGGCCCAGmψACACCmψCCAAG<br>ACAmψGCAGCAACmψGmψGGGmψmψmψACCAmψCACCAGCGCCGACmψACGACAGGGm<br>ψGCmψGGAGAAGCmψGAAGAAGACAGCAACAGGCmψGGAmψGACCACAAmψmψAACGG<br>CAAGGAGCmψGAAGGmψGGAGGGCCAGAmψmψACCmψACmψACAACAGAmψACAAGAG<br>ACAGAACGmψAGmψCAAGGACCmψGmψCCGmψCGAGCmψGGAmψAGACmψGAGCGAAG<br>AAmψCmψGmψGAACAACGACAmψCmψCCmψCCmψGGACAAAGGGCAGAAGCGGAGAAG<br>CmψCmψGAGCCmψCCmψGAAGAAAAGAmψmψCmψCCCAmψAGACCCGmψGCAGGAGAA<br>GmψmψCGmψGmψGCCmψGAACmψGCGGCmψmψCGAGACACACGCAGCCGAGCAAGCCG<br>CCCmψGAACAmψCGCCAGAmψCCmψGGCmψGmψmψCCmψGCGGAGCCAGGAGmψACAA<br>GAAAmψACCAGACAAACAAGACAACCGGCAACACCGAmψAAGAGAGCCmψmψCGmψCG<br>AGACCmψGGCAGmψCCmψmψmψmψACCGGAAGAAGCmψmψAAGGAGGmψGmψGGAAAC<br>CmψGCCGmψGCGGmψCmψGGCGGAmψCmψGGCGGAGGCmψCCACAAGCAmψGAACAAC<br>mψCCCAGGGCAGAGmψGACCmψmψCGAGGACGmψGACCGmψGAAmψmψmψmψACACAG<br>GGAGAGmψGGCAGAGACmψGAACCCCGAGCAGAGAAACCmψGmψACCGGGAmψGmψGA<br>mψGCmψGGAAAACmψACAGCAAmψCmψGGmψGmψCCGmψGGGCCAGGGCGAGACCACA<br>AAGCCmψGACGmψGAmψCCmψGCGmψCmψGGAGCAGGGCAAGGAACCCmψGGCmψGGA<br>GGAGGAGGAGGmψGCmψGGGAAGCGGACGGGCCGAGAAGAACGGCGACAmψCGGCGGA<br>CAGAmψCmψGGAAGCCmψAAGGACGmψGAAAGAAAGCCmψGACCAGCCCCAAGAAAAA<br>GAGAAAAGmψCGACmψACAAGGAmψGACGAmψGACAAGGACmψACAAGGAmψGACGAC<br>GACAAGmψAAmψAGAmψAAGCGGCCGCmψmψAAmψmψAAGCmψGCCmψmψCmψGCGGG<br>GCmψmψGCCmψmψCmψGGCCAmψGCCCmψmψCmψmψCmψCmψCCCmψmψGCACCmψGm<br>ψACCmψCmψmψGGmψCmψmψmψGAAmψAAAGCCmψGAGmψAGGAAGmψcmψagaaaaa<br>aaaaaaaaaaaaaaaaaaaaaaaaaaaaaaaaaaaaaaaaaaaaaaaaaaaaaaaaaa<br>aaaaaaaaaaaaaaaaa |
| LTRP #1 | 3064 | AAAmψAAGAGAGAAAAGAAGAGmψAAGAAGAAAmψAmψAAGAGCCACCAmψGGCCCCm<br>ψAAGAAGAAGCGmψAAAGmψGAGCCGGGmψGAACGGCAGCGGCAGCGGCGGCGGCAmψ<br>GAACCACGACCAGGAGmψmψCGACCCCCCmψAAGGmψGmψACCCmψCCCGmψCCCCGC<br>CGAGAAGAGAAAGCCCAmψCCGGGmψCCmψGAGCCmψGmψmψCGAmψGGCAmψCGCCA<br>CCGGmψCmψGCmψGGmψGCmψGAAGGACCmψGGGCAmψCCAGGmψGGAmψAGGmψACA<br>mψmψGCCmψCCGAGGmψGmψGCGAGGACmψCCAmψCACCGmψGGGAAmψGGmψGCGmψ<br>CAmψCAGGGCAAGAmψCAmψGmψACGmψGGGCGACGmψGCGGAGCGmψGACACAGAAG<br>CAmψAmψCCAGGAGmψGGGGCCCmψmψmψCGACCmψGGmψGAmψCGGCGGCAGCCCmψ<br>mψGCAAmψGACCmψGAGCAmψCGmψGAACCCAGCCCGGAAGGGCCmψGmψACGAGGGA<br>ACCGGCAGACmψGmψmψCmψmψCGAGmψmψmψmψACAGACmψGCmψGCACGACGCCCG<br>GCCmψAAGGAAGGCGACGACCGGCCCmψmψCmψmψmψmψGGCmψGmψmψCGAGAAmψG<br>mψGGmψGGCCAmψGGGAGmψCAGCGACAAGCGGGAmψAmψmψAGCCGGmψmψCCmψGG<br>AGAGCAACCCCGmψGAmψGAmψCGAmψGCCAAGGAAGmψGAGCGCCGCCCACCGGGCC<br>AGAmψACmψmψCmψGGGGCAAmψCmψGCCmψGGCAmψGAACAGACCCCmψGGCCAGCA<br>CCGmψGAACGACAAGCmψGGAGCmψGCAGGAGmψGCCmψGGAGCACGGCCGGAmψCGC<br>CAAGmψmψCAGCAAGGmψGAGAACCAmψCACCACCCGAAGCAACAGCAmψCAAACAAG |

TABLE 12-continued

Full-length RNA sequences of dXR1 and LTRP1-ZIM3 mRNA molecules assessed in experiment #1 of this example. Modification 'mψ' = N1-methyl-pseudouridine.

| dXR or LTRP ID | SEQ ID NO | RNA Sequence |
| --- | --- | --- |
| | | GCAAGGACCAGCACmψmψmψCCmψGmψGmψmψCAmψGAACGAGAAGGAGGACAmψCCm<br>ψGmψGGmψGmψACCGAGAmψGGAGAGAGmψGmψmψCGGGmψmψCCCAGmψCCACmψAC<br>ACAGAmψGmψCAGCAACAmψGmψCmψAGACmψGGCCAGACAGAGACmψGCmψGGGAAG<br>AAGCmψGGmψCCGmψCCCmψGmψGAmψCAGACACCmψGmψmψCGCCCCmψCmψGAAGG<br>AGmψACmψmψCGCCmψGCGmψGAGCAGCGGCAACAGCAACGCCAACAGCCGGGGCCCC<br>AGCmψmψCmψCmψAGCGGCCmψGGmψGCCACmψGmψCCCmψGAGAGGGAGCCACAmψG<br>GGCCCCAmψGGAGAmψCmψACAAAACCGmψGAGCGCCmψGGAAGCGGCAGCCmψGmψG<br>CGCGmψGCmψGAGCCmψGmψmψmψCGGAAmψAmψCGAmψAAAGmψCCmψGAAAAGCCm<br>ψGGGAmψmψCCmψGGAGAGCGGCmψCmψGGCmψCCGGCGGmψGGCACCCmψGAAGmψA<br>CGmψGGAGGAmψGmψGACAAACGmψGGmψCAGACGGGAmψGmψGGAGAAGmψGGGGCC<br>CCmψmψCGAmψCmψGGmψGmψACGGCAGCACCCAACCCCmψGGGCAGCmψCmψmψGmψ<br>GACCGGmψGCCCmψGGCmψGGmψACAmψGmψmψmψCAGmψmψCCACCGGAmψCCmψGC<br>AGmψACGCCCmψGCCGAGACAGGAGmψCCCAGCGGCCAmψmψCmψmψmψmψGGAmψmψ<br>mψmψCAmψGGACAACmψmψGCmψGCmψGACCGAGGAmψGACCAGGAAACmψACCACmψ<br>CGGmψmψCCmψGCAGACCGAAGCCGmψGACCCmψGCAGGACGmψGAGAGGCCGGGACm<br>ψACCAGAACGCCAmψGCGGGmψGmψGGmψCCAACAmψCCCmψGGACmψGAAAAGCAAG<br>CACGCACCmψCmψGACCCCmψAAAGAAGAGGAGmψACCmψGCAGGCCCAGGmψGCGGA<br>GCAGAAGCAAGCmψGGACGCCCCmψAAGGmψGGAmψCmψGCmψGGmψGAAGAAmψmψG<br>CCmψCCmψGCCCCmψGAGAGAGmψACmψmψCAAGmψAmψmψmψCAGCCAGAAmψAGmψ<br>CmψGCCCCmψGGGCGGCCCAAGCAGCGGCGCCCCmψCCmψCCCAGCGGCGGCAGCCCA<br>GCCGGCmψCCCCAACCmψCmψACCGAGGAGGGCACCmψCmψGAGmψCCGCCACCCCCG<br>AGAGCGGCCCmψGGCACCmψCCACCGAGCCCAGCGAGGGCAGCGCACCCGGCAGCCCm<br>ψGCCGGCAGCCCCACCmψCCACAGAGGAGGGAACCAGCACCGAGCCCAGCGAAGGCAG<br>CGCCCCAGGCACCAGCACCGAGCCmψAGmψGAGGGCGGCmψCmψGGCGGCGGCAGCGC<br>CCAGGAGAmψmψAAACGGAmψCAACAAGAmψCAGAAGAAGACmψmψGmψGAAAGACAG<br>CAACACCAAGAAGGCCGGCAAGACAGGCCCCAmψGAAAACCCmψGCmψGGmψmψAGAG<br>mψGAmψGACACCCGAmψCmψGAGAGAGCGGCmψGGAAAACCmψGAGAAAGAAGCCmψG<br>AAAAmψAmψCCCCCAGCCCAmψCAGCAAmψACAmψCmψAGAGCCAACCmψGAAmψAAG<br>CmψGCmψGACCGAmψmψACACCGAAAmψGAAGAAGGCGAmψCCmψGCAmψGmψGmψAC<br>mψGGGAAGAGmψmψCCAGAAGGACCCmψGmψGGGCCmψGAmψGAGCCGGGmψGGCCCA<br>GCCmψGCCAGCAAGAAGAmψCGAmψCAGAACAAGCmψGAAACCmψGAGAmψGGACGAG<br>AAGGGCAACCmψGACCACCGCCGGCmψmψmψGCCmψGCmψCmψCAGmψGmψGGCCAGC<br>CCCmψGmψmψCGmψGmψACAAGCmψGGAGCAGGmψGmψCmψGAGAAGGGCAAGGCmψm<br>ψACACCAACmψACmψmψCGGACGGmψGCAAmψGmψGGCCGAGCACGAAAAGCmψGAmψ<br>CCmψGCmψGGCCCAGCmψGAAGCCCGAGAAGGAmψAGCGACGAAGCCGmψGACAmψAm<br>ψAGCCmψGGGAAAGmψmψmψGGGCAGAGGGCCCmψGGAmψmψmψCmψACAGCAmψmψC<br>AmψGmψGACCAAGGAGmψCCACCCACCCCGmψGAAGCCCCmψGGCCCAGAmψCGCCGG<br>AAACAGAmψACGCCmψCCGGACCmψGmψGGGAAAGGCCCmψGAGCGACGCAmψGmψAm<br>ψGGGCACAAmψCGCCmψCCmψmψCCmψGmψCmψAAGmψACCAGGACAmψCAmψCAmψC<br>GAACACCAGAAGGmψGGmψGAAGGGCAACCAGAAGAGACmψGGAGAGCCmψGCGGGAG<br>CmψGGCCGGCAAGGAAAACCmψGGAAmψACCCmψAGCGmψGACCCmψGCCACCmψCAG<br>CCmψCACACCAAGGAGGGCGmψmψGAmψGCCmψACAACGAAGmψGAmψCGCCCGGGmψ<br>GCGAAmψGmψGGGmψGAACCmψGAACCmψGmψGGCAGAAGCmψGAAGCmψAAGCAGAG<br>AmψGAmψGCCAAGCCmψCmψGCmψGAGACmψGAAGGGAmψmψCCCmψmψCCmψmψmψC<br>CmψCmψGGmψCGAGAGACAGGCCAACGAAGmψGGACmψGGmψGGGACAmψGGmψGmψG<br>mψAACGmψGAAGAAGCmψGAmψCAACGAGAAAAAGGAGGAmψGGCAAGGmψGmψmψmψ<br>mψGGCAGAAmψCmψGGCmψGGCmψACAAGAGACAGGAAGCCCmψGAGACCAmψACCmψ<br>GAGCAGCGAGGAAGAmψCGGAAGAAGGGAAAGAAAmψmψCGCmψCGGmψACCAGCmψG<br>GGCGACCmψGCmψGCmψGCACCmψGGAAAAGAAGCACGGCGAGGACmψGGGGAAAGGm<br>ψGmψACGACGAGGCCmψGGGAGCGGAmψmψGACAAGAAAGmψGGAAGGCCmψGAGCAA<br>GCACAmψCAAGCmψGGAAGAGGAACGGAGAAGCGAGGACGCCCAGAGCAAGGCCGCCC<br>mψGACCGACmψGGCmψGCGGGCmψAAGGCCAGCmψmψCGmψGAmψCGAGGGCCmψGAA<br>GGAGGCCGACAAGGACGAGmψmψCmψGCAGAmψGCGAGCmψGAAGCmψGCAGAAGmψG<br>GmψACGGGGACCmψGCGGGGAAAGCCCmψmψCGCCAmψCGAAGCCGAGAACAGCAmψC<br>CmψGGACAmψCAGCGGCmψmψCAGCAAGCAGmψACAACmψGmψGCCmψmψCAmψCmψG<br>GCAGAAGGACGGCGmψGAAGAAGCmψGAACCmψGmψACCmψGAmψCAmψCAACmψACm<br>ψmψCAAGGGCGGCAAGCmψGCGGmψmψCAAGAAGAmψCAAACCmψGAAGCCmψmψCGA<br>AGCCAACAGAmψmψCmψACACCGmψGAmψCAACAAAAAGAGCGGCGAGAmψCGmψGCC<br>CAmψGGAGGmψGAACmψmψCAACmψmψCGACGACCCCAACCmψGAmψCAmψCCmψGCC<br>mψCmψGGCCmψmψmψGGCAAGAGACAGGGCAGAGAAmψmψCAmψCmψGGAACGACCmψ<br>GCmψGmψCCCmψGGAAACCGGCAGCCmψGAAGCmψGGCCAACGGAAGAGmψGAmψCGA<br>GAAGACACmψGmψACAACAGAAGAACCCGGCAGGAmψGAGCCmψGCCCmψGmψmψCGm<br>ψGGCCCmψGACCmψmψCGAGCGGCGGGAGGmψCCmψGGACmψCCmψCCAAmψAmψCAA<br>ACCAAmψGAACCmψGAmCGGCGmψGGCAAGAGGCGAAAACAmψCCCCGCCGmψGAmψC<br>GCCCmψGACCGACCCCGAGGGCmψGCCCACmψGAGCCGGmψmψmψAAGGAmψAGCCmψ<br>GGGAAACCCAACCCACAmψCCmψGAGAAmψCGGCGAGAGCmψAmψAAGGAGAAGCAGC<br>GGACCAmψCCAGGCCAAGAAGGAGGmψGGAGCAGCGGAGAGCCGGCGGCmψACAGCCG<br>GAAGmψACGCCAGCAAAGCCAAGAAmψCmψGGCAGACGAmψAmψGGmψGAGAAACACC<br>GCmψAGAGAmψCmψGCmψGmψACmψACGCCGmψGACCCAGGAmψGCCAmψGCmψGAmψ<br>ψGGCCGAGAGACAGmψACACACGGAmψGGAGGACmψGGCmψGACCGCCAAGCmψGGCC<br>mψACGAGGGCCmψGAGCAAGACCmψACCmψGmψCCAAGACACmψGGCCCAGmψACACC<br>mψCCAAGACAmψGCAGCAACmψGmψGGGmψmψmψACCAmψCACCAGCGCCGACmψACG<br>ACAGGGmψGCmψGGAGAAGCmψGAAGAAGACAGCAACAGGCmψGGAmψGACCACAAmψ |

TABLE 12-continued

Full-length RNA sequences of dXR1 and LTRP1-ZIM3 mRNA molecules assessed in experiment #1 of this example. Modification 'mψ' = N1-methyl-pseudouridine.

| dXR or LTRP ID | SEQ ID NO | RNA Sequence |
|---|---|---|
| | | mψAACGGCAAGGAGCmψGAAGGmψGGAGGGCCAGAmψmψACCmψACmψACAACAGAmψ ACAAGAGACAGAACGmψAGmψCAAGGACCmψGmψCCGmψCGAGCmψGGAmψAGACmψG AGCGAAGAAmψCmψGmψGAACAACGACAmψCmψCCmψCCmψGGACAAAGGGCAGAAGC GGAGAAGCmψCmψGAGCCmψCCmψGAAGAAAAGAmψmψCmψCCCAmψAGACCCGmψGC AGGAGAAGmψmψCGmψGmψGCCmψGAACmψGCGGCmψmψCGAGACACACGCAGCCGAG CAAGCCGCCCmψGAACAmψCGCCAGAmψCCmψGGCmψGmψmψCCmψGCGGAGCCAGGA GmψACAAGAAAmψACCAGACAAACAAGACAACCGGCAACACCGAmψAAGAGAGCCmψm ψCGmψCGAGACCmψGGCAGmψCCmψmψmψmψACCGGAAGAAGCmψmψAAGGAGGmψGm ψGGAAACCmψGCCGmψGCGGmψCmψGGCGGAmψCmψGGCGGAGGCmψCCACAAGCAmψ GAACAACmψCCCAGGGCAGAGmψGACCmψmψCGAGGACGmψGACCGmψGAAmψmψmψm ψACACAGGGAGAGmψGGCAGAGACmψGAACCCCGAGCAGAGAAACCmψGmψACCGGGA mψGmψGAmψGCmψGGAAAACmψACAGCAAmψCmψGGmψGmψCCGmψGGGCCAGGGCGA GACCACAAAGCCmψGACGmψGAmψCCmψGCGmψCmψGGAGCAGGGCAAGGAACCCmψG GCmψGGAGGAGGAGGAGGmψGCmψGGGAAGCGGACGGGCCGAGAAGAACGGCGACAmψ CGGCGGACAGAmψCmψGGAAGCCmψAAGGACGmψGAAAGAAAGCCmψGACCAGCCCCA AGAAAAAGAGAAAAGmψCGACmψACAAGGAmψGACGAmψGACAAGGACmψACAAGGAm ψGACGACGACAAGmψAAmψAGAmψAAGCGGCCGCmψmψAAmψmψAAGCmψGCCmψmψC mψGCGGGGCmψmψGCCmψmψCmψGGCCAmψGCCCmψmψCmψmψCmψCmψCCCmψmψGC ACCmψGmψACCmψCmψmψGGmψCmψmψmψGAAmψAAAGCCmψGAGmψAGGAAGmψcmψ agaaaaaaaaaaaaaaaaaaaaaaaaaaaaaaaaaaaaaaaaaaaaaaaaaaaaaaaa aaaaaaaaaaaaaaaaaaaaaaaa |

TABLE 13

Full-length protein sequences of dXR1 and LTRP1-ZIM3 molecules assessed in experiment #1 of this example.

| dXR or LTRP ID | Amino acid sequence SEQ ID NO: |
|---|---|
| dXR1 | 3065 |
| LTRP #1 | 3066 |

Synthesis of gRNAs:

In experiment #1, gRNAs targeting the PCSK9 locus were designed using gRNA scaffold 174 and chemically synthesized using the v1 modification profile (as described in Example 7, below). Spacers were designed in proximity to the PCSK9 promoter. The sequences of the PCSK9-targeting spacers and the resulting chemically-modified gRNAs are listed in Table 14.

TABLE 14

Sequences of spacers targeting the PCSK9 locus and chemically-modified gRNAs used in this example. Chemical modifications: * = phosphorothioate bond; m = 2'OMe modification.

| gRNA ID (scaffold-variant spacer) | Target | Targeting spacer sequence (RNA) | SEQ ID NO: | Full gRNA sequence (RNA) | SEQ ID NO: |
|---|---|---|---|---|---|
| 174-6.7 | human PCSK9 | UCCUGGCUUCCUGGUGAAGA | 2008 | mA*mC*mU*GGCGCUUUUAUCUGAUU ACUUUGAGAGCCAUCACCAGCGACUA UGUCGUAGUGGGUAAAGCUCCCUCUU CGGAGGGAGCAUCAAAGUCCUGGCUU CCUGGUGAmA*mG*mA | 3074 |
| 174-27.1 | mouse PCSK9 | GCCUCGCCCUCCCCAGACAG | 3067 | mA*mC*mU*GGCGCUUUUAUCUGAUU ACUUUGAGAGCCAUCACCAGCGACUA UGUCGUAGUGGGUAAAGCUCCCUCUU CGGAGGGAGCAUCAAAGGCCUCGCCC UCCCCAGAmC*mA*mG | 3075 |
| 174-27.88 | mouse PCSK9 | CGCUACCUGCCUAAACUUUG | 3068 | mA*mC*mU*GGCGCUUUUAUCUGAUU ACUUUGAGAGCCAUCACCAGCGACUA UGUCGUAGUGGGUAAAGCUCCCUCUU CGGAGGGAGCAUCAAAGCGCUACCUG CCUAAACUMU*mU*mG | 3076 |
| 174-27.92 | mouse PCSK9 | CCCUCCAACAAUAUUAACUA | 3069 | mA*mC*mU*GGCGCUUUUAUCUGAUU ACUUUGAGAGCCAUCACCAGCGACUA | 3077 |

TABLE 14-continued

Sequences of spacers targeting the PCSK9 locus and chemically-modified gRNAs used in this example. Chemical modifications: * = phosphorothioate bond; m = 2'OMe modification.

| gRNA ID (scaffold-variant spacer) | Target | Targeting spacer sequence (RNA) | SEQ ID NO: | Full gRNA sequence (RNA) | SEQ ID NO: |
|---|---|---|---|---|---|
| | | | | UGUCGUAGUGGGUAAAGCUCCCUCUU CGGAGGGAGCAUCAAAGCCCUCCAAC AAUAUUAAmC*mU*mA | |
| 174-27.93 | mouse PCSK9 | GGGGUCUCCCAGCCACCCCU | 3070 | mA*mC*mU*GGCGCUUUUAUCUGAUU ACUUUGAGAGCCAUCACCAGCGACUA UGUCGUAGUGGGUAAAGCUCCCUCUU CGGAGGGAGCAUCAAAGGGGGUCUCC CAGCCACCmC*mC*mU | 3078 |
| 174-27.94 | mouse PCSK9 | CCCCUCUUAAUCCCCACUCC | 3071 | mA*mC*mU*GGCGCUUUUAUCUGAUU ACUUUGAGAGCCAUCACCAGCGACUA UGUCGUAGUGGGUAAAGCUCCCUCUU CGGAGGGAGCAUCAAAGCCCCUCUUA AUCCCCACmU*mC*mC | 3079 |
| 174-27.100 | mouse PCSK9 | CUCUCUCUUUCUGAGGCUAG | 3072 | mA*mC*mU*GGCGCUUUUAUCUGAUU ACUUUGAGAGCCAUCACCAGCGACUA UGUCGUAGUGGGUAAAGCUCCCUCUU CGGAGGGAGCAUCAAAGCUCUCUCUU UCUGAGGCmU*mA*mG | 3080 |
| 174-27.103 | mouse PCSK9 | UAAUCUCCAUCCUCGUCCUG | 3073 | mA*mC*mU*GGCGCUUUUAUCUGAUU ACUUUGAGAGCCAUCACCAGCGACUA UGUCGUAGUGGGUAAAGCUCCCUCUU CGGAGGGAGCAUCAAAGUAAUCUCCA UCCUCGUCmC*mU*mG | 3081 |

Transfection of mRNA and gRNA into Hepa1-6 Cells and Intracellular PCSK9 Staining:

Seeded Hepa1-6 cells treated with the NATE™ inhibitor were lipofected with 300 ng of mRNA encoding dXR1 or LTRP1-ZIM3 (Table 12) and 150 ng of a PCSK9-targeting gRNA (Table 14). Seven different gRNAs spanning the promoter region of the mouse PCSK9 locus were tested, in addition to a non-targeting sequence complementary to the human PCSK9 gene (Table 14). Cells were harvested at 6, 13, and 25 days after transfection to measure intracellular levels of the PCSK9 protein using an intracellular flow cytometry staining protocol. Briefly, cells were fixed using 4% paraformaldehyde in PBS, permeabilized, and stained using a mouse anti-PCSK9 primary antibody (R&D Systems®), followed by a fluorescent goat anti-mouse IgG secondary antibody (Thermo Fisher®). Fluorescence levels were measured using the Attune™ NxT flow cytometer, and data were analyzed using the FlowJo™ software. Cell populations were gated using the non-targeting gRNA as a negative control.

Experiment #2: LTRP #1 vs. LTRP #5 in Hepa1-6 Cells when Delivered as mRNA

Generation of mRNA:

mRNA encoding LTRP #1 or LTRP #5 (configuration #5 in FIG. 1) containing the ZIM3-KRAB domain (hereafter known as LTRP1-ZIM3 or LTRP5-ZIM3 respectively; configurations are diagrammed in FIG. 1) was generated by IVT in-house using plasmid-based PCR templates. Briefly, PCR was performed on plasmids encoding LTRP #1 or LTRP #5 harboring the ZIM3-KRAB domain with flanking NLSes with a forward primer containing a T7 promoter and reverse primer encoding a 120-nucleotide poly(A) tail. These constructs also contained a 2x FLAG sequence. DNA sequences encoding these molecules are listed in Table 15. The resulting PCR templates were used for IVT reactions, which were carried out with CleanCap® AG and NI-methyl-pseudouridine. IVT reactions were then subjected to DNase digestion and on-column oligo dT purification. Full-length RNA sequences encoding the LTRP mRNAs are listed in Table 16.

As experimental controls, mRNA encoding catalytically-active CasX 491 was also similarly generated by IVT using a PCR template as described. Generation of mRNAs encoding LTRP1-ZIM3 and dCas9-ZNF10-DNMT3A/3L, a catalytically-dead Cas9 fused to both the ZNF10-KRAB domain and DNMT3A/L domains, by IVT by a third-party was performed as described above for experiment #1.

TABLE 15

Encoding sequences of the LTRP1-ZIM3 and LTRP5-ZIM3 mRNA molecules assessed in experiment #2 of this example *.

| LTRP ID | Component | DNA sequence SEQ ID NO: |
|---|---|---|
| LTRP #1-ZIM3-KRAB | 5'UTR | 3082 |
| | START codon + NLS + linker | 3083 |
| | START codon + DNMT3A catalytic domain | 3084 |
| | Linker | 3085 |
| | DNMT3L interaction domain | 3086 |
| | Linker | 3087 |
| | Linker + buffer | 3088 |
| | dCasX491 | 3089 |
| | Linker + buffer | 3090 |
| | ZIM3-KRAB | 3091 |
| | Buffer + NLS | 3092 |
| | Tag | 3093 |
| | Buffer | 3094 |
| | Poly(A) tail | 3095 |
| LTRP #5-ZIM3-KRAB | 5'UTR | 3082 |
| | START codon + NLS + buffer | 3096 |
| | START codon + DNMT3A catalytic domain | 3084 |
| | Linker | 3085 |
| | DNMT3L interaction domain | 3086 |
| | Linker | 3097 |
| | ZIM3-KRAB | 3091 |
| | Linker | 3087 |
| | dCasX491 | 3089 |
| | Linker + buffer | 3090 |
| | NLS | 3098 |
| | Tag | 3093 |
| | Buffer | 3094 |
| | Poly(A) tail | 3095 |

*Components are listed in a 5' to 3' order within the constructs

TABLE 16

Full-length RNA sequences of LTRP1-ZIM3 and LTRP5-ZIM3 mRNA molecules assessed in experiment #2 of this example. Modification 'mψ' = N1-methyl-pseudouridine

| LTRP ID | SEQ ID NO | RNA Sequence |
|---|---|---|
| LTRP #1-ZIM3-KRAB | 3099 | GACCGGCCGCCACCAmψGGCCCCAAAGAAGAAGCGGAAGGmψCmψCmψAGAGmψmψA<br>ACGGAmψCAGGCmψCmψGGAGGmψGGAAmψGAACCAmψGACCAGGAAmψmψmψGACC<br>GmψGCmψGmψCmψCmψCmψmψmψGAmψGGGAmψmψGCmψACAGGGCmψCCmψGGmψG<br>CmψGAAGGACCmψGGGCAmψCCAAGmψGGACCGCmψACAmψCGCCmψCCGAGGmψGm<br>ψGmψGAGGACmψCCAmψCACGGmψGGGCAmψGGmψGCGGCACCAGGGAAAGAmψCAm<br>ψGmψACGmψCGGGGACGmψCCGCAGCGmψCACACAGAAGCAmψAmψCCAGGAGmψGG<br>GGCCCAmψmψCGACCmψGGmψGAmψmψGGAGGCAGmψCCCmψGCAACGACCmψCmψC<br>CAmψmψGmψCAACCCmψGCCCGCAAGGGACmψmψmψAmψGAGGGmψACmψGGCCGCC<br>GAGGGAGAmψGAmψCGCCCCmψmψCmψmψCmψGGCmψCmψmψmψGAGAAmψGmψGGm<br>ψGGCCAmψGGGCGmψmψAGmψGACAAGAGGGACAmψCmψCGCGAmψmψmψCmψmψGA<br>GGGCCCGmψmψACmψmψCmψGGGGmψAACCmψmψCCmψGGCAmψGAACAGGCCmψmψ<br>mψGGCAmψCCACmψGmψGAAmψGAmψAAGCmψGGAGCmψGCAAGAGmψGmψCmψGGA<br>GCACGGCAGAAmψAGCCAAgmψmψCAGCAAAGmψGAGGACCAmψmψACCACCAGGmψ<br>CAAACmψCmψAmψAAAGCAGGGCAAAGACCAGCAmψmψmψCCCCGmψCmψmψCAmψG<br>AACGAGAAGGAGGACAmψCCmψGmψGGmψGCACmψGAAmψGGAAAGGGmψGmψmψψm<br>ψGGCmψmψCCCCGmψCCACmψACACAGACGmψGmψCCAACAmψGAGCCGCmψmψGGC<br>GAGGCAGAGACmψGCmψGGGCCGGmψCGmψGGAGCGmψGCCGGmψCAmψCCGCCACC<br>mψCmψmψCGCmψCCGCmψGAAGGAAmψAmψmψmψmψGCmψmψGmψGmψGmψCmψAGC<br>GGCAAmψAGmψAACGCmψAACAGCCGCGGGCCGAGCmψmψCAGCAGCGGCCmψGGmψ<br>GCCGmψmψAAGCmψmψGCGCGGCAGCCAmψAmψGGGCCCmψAmψGGAGAmψAmψACA<br>AGACAGmψGmψCmψGCAmψGGAAGAGACAGCCAGmψGCGGGmψACmψGAGCCmψCmψ<br>mψCAGAAACAmψCGACAAGGmψACmψAAAGAGmψmψmψGGGCmψmψCmψmψGGAAAG<br>CGGmψmψCmψGGmψmψCmψGGGGGAGGAACGCmψGAAGmψACGmψGGAAGAmψGmψC<br>ACAAAmψGmψCGmψGAGGAGGGACGmψGGAGAAAmψGGGGCCCCmψmψmψGACCmψG<br>GmψGmψACGGCmψCGACGCAGCCCCmψAGGCAGCmψCmψmψGmψGAmψCGCmψGmψC<br>CCGGCmψGGmψACAmψGmψmψCCAGmψmψCCACCGGAmψCCmψGCAGmψAmψGCGCm<br>ψGCCmψCGCCAGGAGAGmψCAGCGGCCCmψmψCmψmψCmψGGAmψAmψmψCAmψGGA<br>CAAmψCmψGCmψGCmψGACmψGAGGAmψGACCAAGAGACAACmψACCCGCmψmvCCm<br>ψmψCAGACAGAGGCmψGψVGACCCmψCCAGGAmψGmψCCGmψGGCAGAGACmψACCA<br>GAAmψGCmψAmψGCGGGmψGmψGGAGCAACAmψmψCCAGGGCmψGAAGAGCAAGCAm<br>ψGCGCCCCmψGACCCCAAAGGAAGAAGAGmψAmψCmψGCAAGCCCAAGmψCAGAAGC<br>AGGAGCAAGCmψGGACGCCCCGAAAGmψmψGACCmψCCmψGGmψGAAGAACmψGCCm |

TABLE 16-continued

Full-length RNA sequences of LTRP1-ZIM3 and LTRP5-ZIM3 mRNA molecules assessed in experiment #2 of this example. Modification 'mψ' = N1-methyl-pseudouridine

| LTRP ID | SEQ ID NO | RNA Sequence |
|---|---|---|
| | | ψmψCmψCCCGCmψGAGAGAGmψACmψmψCAAGmψAmψmψmψmψmψCmψCAAAACmψC<br>ACmψmψCCmψCmψmψGGAGGGCCGAGCmψCmψGGCGCACCCCCACCAAGmψGGAGGG<br>mψCmψCCmψGCCGGGmψCCCCAACAmψCmψACmψGAAGAAGGCACCAGCGAAmψCCG<br>CAACGCCCGAGmψCAGGCCCmψGGmψACCmψCCACAGAACCAmψCmψGAAGGmψAGm<br>ψGCGCCmψGGmψmψCCCCAGCmψGGAAGCCCmψACmψmψCCACCGAAGAAGGCACGm<br>ψCAACCGAACCAAGmψGAAGGAmψCmψGCCCCmψGGGACCAGCACmψGAACCAmψCm<br>ψGAGGGCGGmψmψCCGGCGGAGGAAGCGCmψCAAGAGAmψCAAGAGAAmψCAACAAG<br>AmψCAGAAGGAGACmψGGmψCAAGGACAGCAACACAAAGAAGGCCGGCAAGACAGGC<br>CCCAmψGAAAACCCmψGCmψCGmψCAGAGmψGAmψGACCCCmψGACCmψGAGAGAGC<br>GGCmψGGAAAACCmψGAGAAAGAAGCCCGAGAACAmψCCCmψCAGCCmψAmψCAGCA<br>ACACCAGCAGGGCCAACCmψGAACAAGCmψGCmψGACCGACmψACACCGAGAmψGAA<br>GAAAGCCAmψCCmψGCACGmψGmψACmψGGGAAGAGmψmψCCAGAAAGACCCCGmψG<br>GGCCmψGAmψGAGCAGAGmψmψGCmψCAGCCmψGCCAGCAAGAAGAmψCGACCAGAA<br>CAAGCmψGAAGCCCGAGAmψGGACGAGAAGGGCAAmψCmψGACCACAGCCGGCmψmψ<br>mψGCCmψGCmψCmψCAGmψGmψGGCCAGCCmψCmψGmψmψCGmψGmψACAAGCmψGG<br>AACAGGmψGmψCCGAGAAAGGCAAGGCCmψACACCAACmψACmψmψCGGCAGAmψGm<br>ψAACGmψGGCCGAGCACGAGAAGCmψGAmψmψCmψGCmψGGCCCAGCmψGAAACCmψ<br>GAGAAGGACmψCmψGAmψGAGGCCGmψGACCmψACAGCCmψGGGCAAGmψmψmψGGA<br>CAGAGAGCCCmψGGACmψmψCmψACAGCAmψCCACGmψGACCAAAGAAAGCACACAC<br>CCCGmψGAAGCCCCmψGGCmvCAGAmψCGCCGGCAAmψAGAmψACGCCmψCmψGGAC<br>CmψGmψGGGCAAAGCCCmψGmψCCGAmψGCCmψGCAmψGGGAACAAmψCGCCAGCmψ<br>mψCCmψGAGCAAGmψACCAGGACAmψCAmψCAmψCGAGCACCAGAAGGmψGGmψCAA<br>GGGCAACCAGAAGAGACmψGGAAAGCCmψGAGGGAGCmψGGCCGGCAAAGAGAACCm<br>ψGGAAmψACCCCAGCGmψGACCCmψGCCmψCCmψCAGCCmψCACACAAAAGAAGGCG<br>mψGGACGCCmψACAACGAAGmψGAmψCGCCAGAGmψGAGAAmψGmψGGGmψCAACCm<br>CmψGAGACmψGAAGGGCmψmψCCCmψAGCmψmψCCCmψCmψGGmψGGAAAGACAGGC<br>CAAmψGAAGmψGGAmψmψGGmψGGGACAmψGGmψCmψGCAACGmψGAAGAAGCmψGA<br>mψCAACGAGAAGAAAGAGGAmψGGCAAGGmψmψmψmψCmψGGCAGAACCmψGGCCGG<br>CmψACAAGAGACAAGAAGCCCmψGAGGCCmψmψACCmψGAGCAGCGAAGAGGACCGG<br>AAGAAGGGCAAGAAGmψmψCGCCAGAmψACCAGCmψGGGCGACCmψGCmψGCmψGCA<br>CCmψGGAAAAGAAGCACGGCGAGGACmψGGGGCAAAGmψGmψACGAmψGAGGCCmψG<br>GGAGAGAAmψCGACAAGAAGGmψGGAAGGCCmψGAGCAAGCACAmψmψAAGCmψGGA<br>AGAGGAAAGAAGGAGCGAGGACGCCCAAmψCmψAAAGCCGCmψCmψGACCGAmψmψG<br>GCmψGAGAGCCAAGGCCAGCmψmψmψGmψGAmψCGAGGGCCmψGAAAGAGGCCGACA<br>AGGACGAGmψmψCmψGCAGAmψGCGAGCmψGAAGCmψGCAGAAGmψGGmψACGGCGA<br>mψCmψGAGAGGCAAGCCCmψmψCGCCAmψmψGAGGCCGAGAACAGCAmψCCmψGGAC<br>AmψCAGCGGCmψmψCAGCAAGCAGmψACAACmψGCGCCmψmψCAmψmψmψGGCAGAA<br>AGACGGCGmψCAAGAAACmψGAACCmψGmψACCmψGAmψCAmψCAAmψmψACmψmψC<br>AAAGGCGGCAAGCmψGCGGmψmψCAAGAAGAmψCAAACCCGAGGCCmψmψCGAGGCm<br>ψAACAGAmψmψCmψACACCGmψGAmψCAACAAAAAGmψCCGGCGAGAmψCGmψGCCC<br>AmψGGAGmψGAACmψmψCAACmψmψCGACGACCCCAACCmψGAmψmψmAmψCCmψGC<br>CmψCmψGGCCmψmψCGGCAAGAGACAGGGCAGAGAGmψmψCAmψCmψGGAACGAmψC<br>mψGCmψGAGCCmψGGAAACCGGCmψCmψCmψGAAGCmψGGCCAAmψGGCAGAGmψGA<br>mψCGAGAAAACCCmψGmψACAACAGGAGAACCAGACAGGACGAGCCmψGCmψCmψGm<br>ψmψmψGmψGGCCCmψGACCmψmψCGAGAGAAGAGAGGmψGCmψGGACAGCAGCAACA<br>mψGmψGAmψCGCCCmψGACAGACCCmψGAAGGAmψGCCCACmψGAGCAGAmψmψCAA<br>GGACmψCCCmψGGGCAACCCmψACACACAmψCCmψGAGAAmψCGGCGAGAGCmψACA<br>AAGAGAAGCAGAGGACAAmψCCAGGCCAAGAAAGAGGmψGGAACAGAGAAGAGCCGG<br>CGGAmψACmψCmψAGGAAGmψACGCCAGCAAGGCCAAGAAmψCmψGGCCGACGACAm<br>ψGGmψCCGAAACACCGCCAGAGAmψCmψGCmψGmψACmψACGCCGmψGACACAGGAC<br>GCCAmψGCmψGAmψCmψmψCGCGAAmψCmψGAGCAGAGGCmψmψCGGCCGGCAGGGC<br>mψCACAGCmψAAACmψGGCCmψACGAGGGACmψGAGCAAGACCmψACCmψGmψCCAA<br>AACACmψGGCCCAGmψAmψACCmψCCAAGACCmψGCAGCAAmψmψGCGGCmψmψCAC<br>CAmψCACCAGCGCCGACmψACGACAGAGmψGCmψGGAAAAGCmψCAAGAAAACCGCC<br>ACCGGCmψGGAmψGACCACCAmψCAACGGCAAAGAGCmψGAAGGmψmψGAGGGCCAG<br>AmψCACCmψACmψACAACAGGmψACAAGAGGCAGAACGmψCGmψGAAGGAmψCmψGA<br>GCGmψGGAACmψGGACAGACmψGAGCGAAGAGAGCGmψGAACAACGACAmψCAGCAG<br>CmψGGACAAAGGGCAGAmψCAGGCGAGGCmψCmψGAGCCmψGCmψGAAGAAGAGGmψ<br>mψmψAGCCACAGACCmψGmψGCAAGAGAAGmψmψCGmψGmψGCCmψGAACmvGCGGC<br>mψmψCGAGACACACGCCGCmψGAACAGGCmψGCCCmψGAACAmψmψGCCAGAAGCmψ<br>GGCmψGmψmψCCmψGAGAAGCCAAGAGmψACAAGAAGmψACCAGACCAACAAGACCA<br>CCGGCAACACCGACAAGAGGGCCmψmψmψGmψGGAAACCmψGGCAGAGCmψmψCmψA<br>CAGAAAAAAGCmψGAAAGAAGmψCmψGGAAGCCCGCCGmψGCGAmψCGGGCGGmψmψ<br>CCGGCGGAGGmψmψCCACmψAGmψAmVGAACAAmψmψCCCAGGGAAGAGmψGACCmψ<br>mψCGAGGAmψGmψCACmψGmψGAACmψmψCACCCAGGGGGAGmψGGCAGCGGCmψGA<br>AmψCCCGAACAGAGAAACmψmψGmψACAGGGAmψGmψGAmψGCmψGGAGAAmψmψAC<br>AGCAACCmψmψGmψCmψCmψGmψGGGACAAGGGGAAACCACCAAACCCGAmψGmψGA<br>mψCmψmψGAGGmψmψGGAACAAGGAAAGGAGCCAmψGGmψmψGGAGGAAGAGGAAGm<br>ψGCmψGGGAAGmψGGCCGmψGCAGAAAAAAAmψGGGGACAmψmψGGAGGGCAGAmψm<br>ψmψGGAAGCCAAAGGAmψGmψGAAAGAGAGmψCmψCACmψAGmψCCAAAAAAGAAGA<br>GAAAGGmψAGAmψmψACAAAGAmψGACGAmψGACAAAGACmψACAAGGAmψGAmψGA<br>mψGAmψAAGGGAmψCCGGCmψGAAAAAAAAAAAAAAAAAAAAAAAAAAAAAAAAAA<br>AAAAAAAAAAAAAAAAAAAAAAAAAAAAAAAAAAAAAAAAAAAAAAAAAAAA<br>AAAAAAAAAAAAAAAAAAAAAAAAAAA |

TABLE 16-continued

Full-length RNA sequences of LTRP1-ZIM3 and LTRP5-ZIM3 mRNA molecules assessed in experiment #2 of this example. Modification 'mψ' = N1-methyl-pseudouridine

| LTRP ID | SEQ ID NO | RNA Sequence |
|---|---|---|
| LTRP #5-ZIM3-KRAB | 3100 | GACCGGCCGCCACCAmψGGCCCCAAAGAAGAAGCGGAAGGmψCmψCmψAGAAmψGAA<br>CCAmψGACCAGGAAmψmψmψGACCCCCCAAAGGmψmψmψACCCACCmψGmψGCCAGC<br>mψGAGAAGAGGAAGCCCAmψCCGCGmψGCmψGmψCmψCmψCmψmψmψGAmψGGGAmψ<br>mψGCmψACAGGGCmψCCmψGGmψGCmψGAAGGACCmψGGGCAmψCCAAGmψGGACCG<br>CmψACAmψCGCCmψCCGAGGmψGmψGmψGAGGACmψCCAmψCACGGmψGGGCAmψGG<br>mψGCGGCACCAGGGAAAGAmψCAmψGmψACGmψCGGGGACGmψCCGCAGCGmψCACA<br>CAGAAGCAmψAmψCCAGGAGmψGGGGCCCAmψmψCGACCmψGGmψGAmψmψGGAGGC<br>AGmψCCCmψGCAACGACCmψCmψCCAmψmψGmψCAACCCmψGCCCGCAAGGGACmψm<br>ψmψAmψGAGGGmψACmψGGCCGCCmψCmψmψCmψmψmψGAGmψmψCmψACCGCCmψC<br>CmψGCAmψGAmψGCGCGGCCCAAGGAGGGAGAmψGAmψCGCCCCmψmψCmψmψCmψG<br>GCmψCmψmψmψGAGAAmψGmψGGmψGGCCAmψGGGCGmψmψAGmψGACAaGAGGGAC<br>AGAAGmψGmψCmψGCmψGCACACAGGGCCCGmψmψACmψmψCmψGGGGmψAACCmψm<br>ψccmψGGCAmψGAACAGGCCmψmvmψGGCAmψCCACmψGmψGAAmψGAmψAAGCmψG<br>GAGCmψGCAAGAGmψGmψCmψGGAGCACGGCAGAAmψAGCCAAGmψmψCAGCAAAGm<br>ψGAGGACCAmψmψACCACCAGGmψCAAACmψCmψAmψAAAGCAGGGCAAAGACCAGC<br>AmψmψmψCCCCGmψCmψmψCAmψGAACGAGAAGGAGGACAmψCCmψGmψGGmψGCAC<br>mψGAAAmψGGAAAGGGmψGmψmψmψGGCmψmψCCCCGmψCCACmψACACAGACGmψG<br>mψCCAACAmψGAGCCGCmψmψGGCGAGGCAGAGACmψGCmψGGGCCGGmψCGmψGGA<br>GCGmψGCCGGmψCAmψCCGCCACCmψCmψmψCGCmψCCGCmψGAAGGAAmψAmψmψm<br>ψmψGCmψmψGmψGmψGmψCmψAGCGGCAAmψAGmψAACGCmψAACAGCCGCGGGCCG<br>AGCmψmψCAGCAGCGGCCmψGGmψGCCGmψmψAAGCmψmψGCGCGGCAGCCAmψAmψ<br>GGGCCCmψAmψGGAGAmψAmψACAAGACAGmψGmψCmψGCAmψGGAAGAGACAGCCA<br>GmψGCGGGmψACmψGAGCCmψCmψmψCAGAAACAmψCGACAAGGmψACmψAAAGAGm<br>ψmψmψGGGCmψmψCmψmψGGAAAGCGGmψmψCmψGGmψmψCmψGGGGGAGGAACGCm<br>ψGAAGmψACGmψGGAAGAmψGmψCACAAAmψGmψCGmψGAGGAGGGACGmψGGAGAA<br>AmψGGGGCCCCmψmψmψGACCmψGGmψGmψACGGCmψCGACGCAGCCCCmψAGGCAG<br>CmψCmψmψGmψGAmψCGCmψGmψCCCGGCmψGGmψACAmψGmψmψCCAGmψmψCCAC<br>CGGAmψCCmψGCAGmψAmψGCGCmψGCCmψCGCCAGGAGAGmψCAGCGGCCCmψmψC<br>mψmψCmψGGAmψAmψmψCAmψGGACAAmψCmψGCmψGCmψGACmψGAGGAmψGACCA<br>AGAGACAACmψACCCGCmψmψCCmψmψCAGACAGAGGCmψGmψGACCCmψCCAGGAm<br>ψGmψCCGmψGGCAGAGACmψACCAGAAmψGCmψAmψGCGGGmψGmψGGaGCAACAmψ<br>mψCCAGGGCmψGAAGAGCAAGCAmψGCGCCCCmψGACCCCAAAGGAAGAAGAGmψAm<br>ψCmψGCAAGCCCAAGmψCAGAAGCAGGAGCAAGCmψGGACGCCCCGAAAGmψmψGAC<br>CmψCCmψGGmψGAAGAACmψGCCmψmψCmψCCCGCmψGAGAGAGmψACmψmψCAAGm<br>ψAmψmψmψmψmψCmψCAAAACmψCACmψmψCCmψCmψmψGGCGGmψmψCCGGCGGAG<br>GAAmψGAACAAmψmψCCCAGGGAAGAGmψGACCmψmψCGAGGAmψGmψCACmψGmψG<br>AACmψmψCACCCAGGGGGAGmψGGCAGCGGCmψGAAmψCCCGAACAGAGAAACmψmψ<br>GmψACAGGGAmψGmψGAmψGCmψGGAGAAmψmψACAGCAACCmψmψGmψCmψCmψGm<br>ψGGGACAAGGGGAAACCACCAAACCCGAmψGmψGAmψCmψmψGAGGmψmψGGAACAA<br>GGAAAGGAGCCAmψGGmψmψGGAGGAAGAGGAAGmψGCmψGGGAAGmψGGCCGmψGC<br>AGAAAAAAAmψGGGGACAmψmψGGAGGGCAGAmψmψmψGGAAGCCAAAGGAmψGmψG<br>AAAGAGAGmψCmψCGGAGGGCCGAGCmψCmψGGCGCACCCCCACCAAGmψGGAGGGm<br>ψCmψCCmψGCCGGGmψCCCCAACAmψCmψACmψGAAGAAGGCACCAGCGAAmψCCGC<br>AACGCCCGAGmψCAGGCCCmψGGmψACCmψCCACAGAACCAmψCmψGAAGGmψAGmψ<br>GCGCCmψGGmψmψCCCCAGCmψGGAAGCCCmψACmψmψCCACCGAAGAAGGCACGmψ<br>CAACCGAACCAAGmψGAAGGAmψCmψGCCCCmψGGGACCAGCACmψGAACCAmψCmψ<br>GAGCAAGAGAmψCAAGAGAAmψCAACAAGAmψCAGAAGGAGACmψGGmψCAAGGACA<br>GCAACACAAAGAAGGCCGGCAAGACAGGCCCCAmψGAAAACCCmψGCmψCGmψCAGA<br>GmψGAmψGACCCCmψGACCmψGAGAGAGCGGCmψGGAAAACCmψGAGAAAGAAGCCC<br>GAGAACAmψCCCmψCAGCCmψAmψCAGCAACACCAGCAGGGCCAACCmψGAACAAGC<br>mψGCmψGACCGACmψACACCGAGAmψGAAGAAAGCCAmψCCmψGCACGmψGmψACmψ<br>GGGAAGAGmψmψCCAGAAAGACCCCGmψGGGCCmψGAmvGAGCAGAGmvmψGCmψCA<br>GCCmψGCCAGCAAGAAGAmψCGACCAGAACAAGCmψGAAGCCCGAGAmψGGACGAGA<br>AGGGCAAmψCmψGACCACAGCCGGCmψmψmψGCCmψGCmψCmψCAGmψGmψGGCCAG<br>CCmψCmψGmψmψCGmψGmψACAAGCmψGGAACAGGmψGmψCCGAGAAAGGCAAGGCC<br>mψACACCAACmψACmψmψCGGCAGAmψGmψAACGmψGGCCGAGCACGAGAAGCmψGA<br>mψmψCmψGCmψGGCCCAGCmψGAAACCmψGAGAAGGACmψCmψGAmψGAGGCCGmψG<br>ACCmψACAGCCmψGGGCAAGmψmψmψGGACAGAGAGCCCmψGGACmψmψCmψACAGC<br>AmψCCACGmψGACCAAAGAAAGCACACACCCCGmψGAAGCCCCmψGGCmψCAGAmψC<br>GCCGGCAAmψAGAmψACGCCmψCmψGGACCmψGmψGGGCAAAGCCCmψGmψCCGAmψ<br>GCCmψGCAmψGGGAACAAmψCGCCAGCmψmψCCmψGAGCAAGmψACCAGGACAmψCA<br>mψCAmψCGAGCACCAGAAGGmψGGmψCAAGGGCAACCAGAAGAGACmψGGAAAGCCm<br>ψGAGGGAGCmψGGCCGGCAAAGAGAACCmψGGAAmψACCCCAGCGmψGACCCmψGCC<br>mψCCmψCAGCCmψCACACAAAAGAAGGCGmψGGACGCCmVACAACGAAGmψGAmψCG<br>CCAGAGmψGAGAAmψGmψGGGmψCAACCmψGAACCmψGmψGGCAGAAGCmψGAAACm<br>ψGmψCCAGGGACGACGCCAAGCCmψCmψGCmψGAGACmψGAAGGGCmψmψCCCmψAG<br>CmψmψCCCmψCmψGGmψGGAAAGACAGGCCAAmψGAAGmψGGAmψmψGGmψGGGACA<br>mψGGmψCmψGCAACGmψGAAGAAGCmψGAmψCAACGAGAAGAAAGAGGAmUGGCAAG<br>GmψmψmψmψCmψGGCAGAACCmψGGCCGGCmψACAAGAGACAAGAAGCCCmψGAGGC<br>CmψmψACCmψGAGCAGCGAAGAGGACCGGAAGAAGGGCAAGAAGmψmψCGCCAGAmψ<br>ACCAGCmψGGGCGACCmψGCmψGCmψGCACCmψGGAAAAGAAGCACGGCGAGGACmψ<br>GGGGCAAAGmψGmψACGAmψGAGGCCmψGGGAGAGAAmψCGACAAGAAGGmψGGAAG<br>GCCmψGAGCAAGCACAmψmψAAGCmψGGAAGAGGAAAGAAGGAGCGAGGACGCCCAA |

TABLE 16-continued

Full-length RNA sequences of LTRP1-ZIM3 and LTRP5-ZIM3 mRNA molecules assessed in experiment #2 of this example. Modification 'mψ' = N1-methyl-pseudouridine

| LTRP ID | SEQ ID NO | RNA Sequence |
|---|---|---|
| | | mψCmψAAAGCCGCmψCmψGACCGAmψmψGGCmψGAGAGCCAAGGCCAGCmψmψmψGm<br>ψGAmψCGAGGGCCmψGAAAGAGGCCGACAAGGACGAGmψmψCmψGCAGAmψGCGAGC<br>mψGAAGCmψGCAGAAGmψGGmψACGGCGAmψCmψGAGAGGCAAGCCCmψmψCGCCAm<br>ψmψGAGGCCGAGAACAGCAmψCCmψGGACAmψCAGCGGCmψmψCAGCAAGCAGmψAC<br>ACAAAAAGmψCCGGCGAGAmψCGmVGCCCAmψGGAAGmψGAACmψmψCAACmψmψCG<br>mψACCmψGAmψCAmψCAAmψmψACmψmψCAAAGGCGGCAAGCmψGCGGmψmψCAAGA<br>AGAmψCAAACCCGAGGCCmψmψCGAGGCmψAACAGAmψmψCmψACACCGmψGAmψCA<br>ACAAAAAGmψCCGGCGAGAmψCGmψGCCCAmψGGAAGmψGAACmψmψCAACmψmψCG<br>ACGACCCCAACCmψGAmψmψAmψCCmψGCCmψCmψGGCCmψmψCGGCAAGAGACAGG<br>GCAGAGAGmψmψCAmψCmψGGAACGAmψCmψGCmψGAGCCmψGGAAACCGGCmψCmψ<br>CmψGAAGCmψGGCCAAmψGGCAGAGmψGAmψCGAGAAAACCCmψGmψACAACAGGAG<br>AACCAGACAGGACGAGCCmψGCmψCmψGmψmψmψGmψGGCCCmψGACCmψmψCGAGA<br>GAAGAGAGGmψGCmψGGACAGCAGCAACAmψCAAGCCCAmψGAACCmψGAmψCGGCG<br>mψGGCCCGGGGCGAGAAmψAmψCCCmψGCmψGmψGAmψCGCCCmψGACAGACCCmψG<br>AAGGAmψGCCCACmψGAGCAGAmψmψCAAGGACmψCCCmψGGGCAACCCmψACACAC<br>AmψCCmψGAGAAmψCGGCGAGAGCmψACAAAGAGAAGCAGAGGACAAmψCCAGGCCA<br>AGAAAGAGGmψGGAACAGAGAAGAGCCGGCGGAmψACmψCmψAGGAAGmψACGCCAG<br>CAAGGCCAAGAAmψCmψGGCCGACGACAmψGGmψCCGAAACACCGCCAGAGAmψCmψ<br>GCmψGmψACmψACGCCGmψGACACAGGACGCCAmψGCmψGAmψCmψmψCGCGAAmψC<br>mψGAGCAGAGGCmψmψCGGCCGGCAGGGCAAGAGAACCmψmψmψAmψGGCCGAGAGG<br>CAGmψACACCAGAAmψGGAAGAmψmψGGCmψCACAGCmψAAACmψGGCCmψACGAGG<br>GACmψGAGCAAGACCmψACCmψGmψCCAAAACACmψGGCCCAGmψAmψACCmψCCAA<br>GACCmψGCAGCAAmψmψGCGGCmψmψCACCAmψCACCAGCGCCGACmψACGACAGAG<br>mψGCmψGGAAAAGCmψCAAGAAAACCGCCACCGGCmψGGAmψGACCACCAmψCAACG<br>GCAAAGAGCmψGAAGGmψmψGAGGGCCAGAmψCACCmψACmψACAACAGGmψACAAG<br>AGGCAGAACGmψCGmψGAAGGAmψCmψGAGCGmψGGAACmψGGACAGACmψGAGCGA<br>AGAGAGCGmψGAACAACGACAmψCAGCAGCmψGGACAAAGGGCAGAmψCAGGCGAGG<br>CmψCmψGAGCCmψGCmψGAAGAAGAGGmψmψmψAGCCACAGACCmψGmψGCAAGAGA<br>AGmψmψCGmψGmψGCCmψGAACmψGCGGCmψmψCGAGACACACGCCGCmψGAACAGG<br>CmψGCCCmψGAACAmψmψGCCAGAAGCmψGGCmψGmψmψCCmψGAGAAGCCAAGAGm<br>ψACAAGAAGmψACCAGACCAACAAGACCACCGGCAACACCGACAAGAGGGCCmψmψm<br>ψGmψGGAAACCmψGGCAGAGCmψmψCmψACAGAAAAAAGCmψGAAAGAAGmψCmψGG<br>AAGCCCGCCGmψGCGAmψCGGGCGGmψmψCCGGCGGAGGmψmψCCACmψAGmψCCAA<br>AAAAGAAGAGAAAGGmψAGAmψmψACAAAGAmψGACGAmψGACAAAGACmψACAAGG<br>AmψGAmψGAmψGAmψAAGGGAmψCCGGCmψGAAAAAAAAAAAAAAAAAAAAAAAAA<br>AAAAAAAAAAAAAAAAAAAAAAAAAAAAAAAAAAAAAAAAAAAAAAAAAAAAAAA<br>AAAAAAAAAAAAAAAAAAAAAAAAAAAAAAAAAAAAA |

For experiment #2, synthesis of PCSK9-targeting gRNAs was performed as described above for experiment #1, and the sequences of the targeting spacers are listed in Table 14. For pairing with dCas9-ZNF10-DNMT3A/3L, targeting spacers were as follows: 1) 7.148 (B2M, as non-targeting control; CGCGAGCACAGCUAAGGCCA; SEQ ID NO: 3101), 27.126 (PCSK9; CACGCCACCCCGAGCCCCAU; SEQ ID NO: 3102), and 27.128 (PCSK9; CAGCCUGCGC-GUCCACGUGA; SEQ ID NO: 3103).

Transfection of mRNA and gRNA into Hepa1-6 Cells and Intracellular PCSK9 Staining:

Seeded Hepa1-6 cells treated with the NATE™ inhibitor were lipofected with 300 ng of mRNA encoding LTRP1-ZIM3, LTRP5-ZIM3, catalytically-active CasX 491, or dCas9-ZNF10-DNMT3A/3L, and 150 ng of PCSK9-targeting gRNA (Table 14). Intracellular levels of PCSK9 protein were measured at 7, 14, 21, 36, and 71 days post-transfection using an intracellular staining protocol as described earlier for experiment #1.

Results

Figure 4:
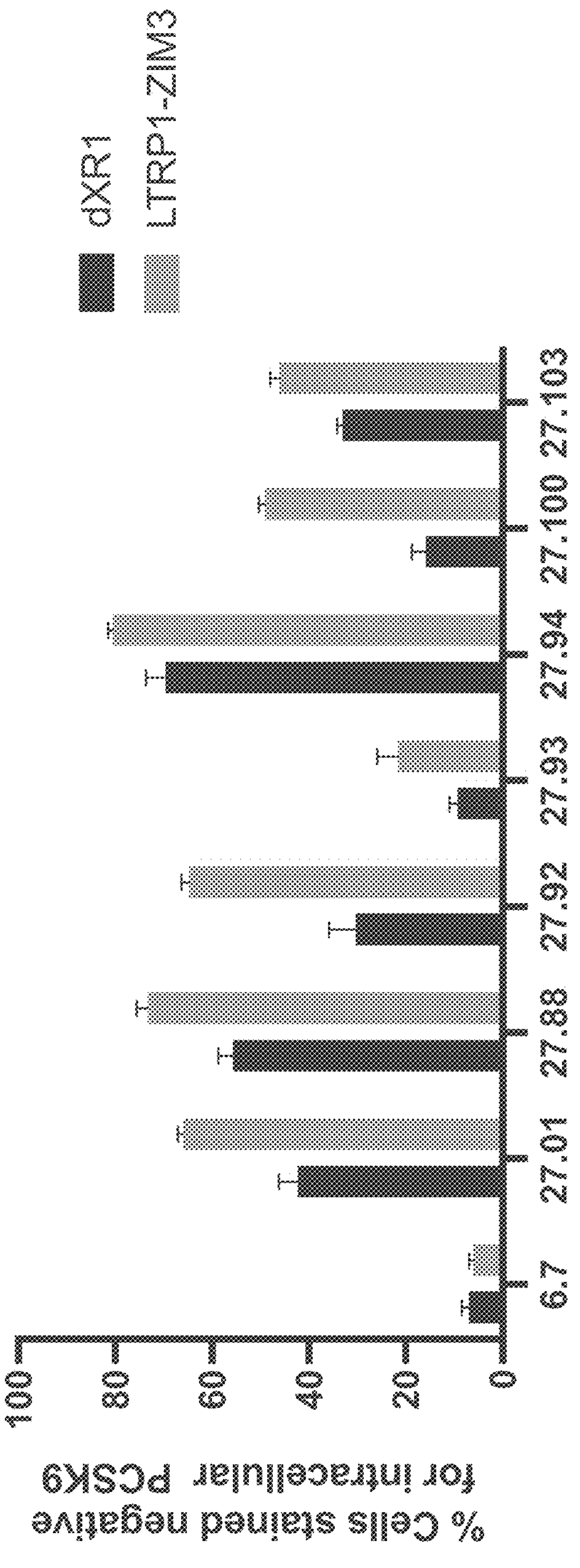
FIG. 4 is a bar plot showing the percentage of mouse Hepa1-6 cells, treated with either dXR1 or LTRP1-ZIM3 mRNA paired with the indicated PCSK9-targeting gRNAs, that stained negative for intracellular PCSK9 at day 6, as described in Example 2. Spacer 6.7 targeting the human PCSK9 locus served as a non-targeting control.
Figure 5:
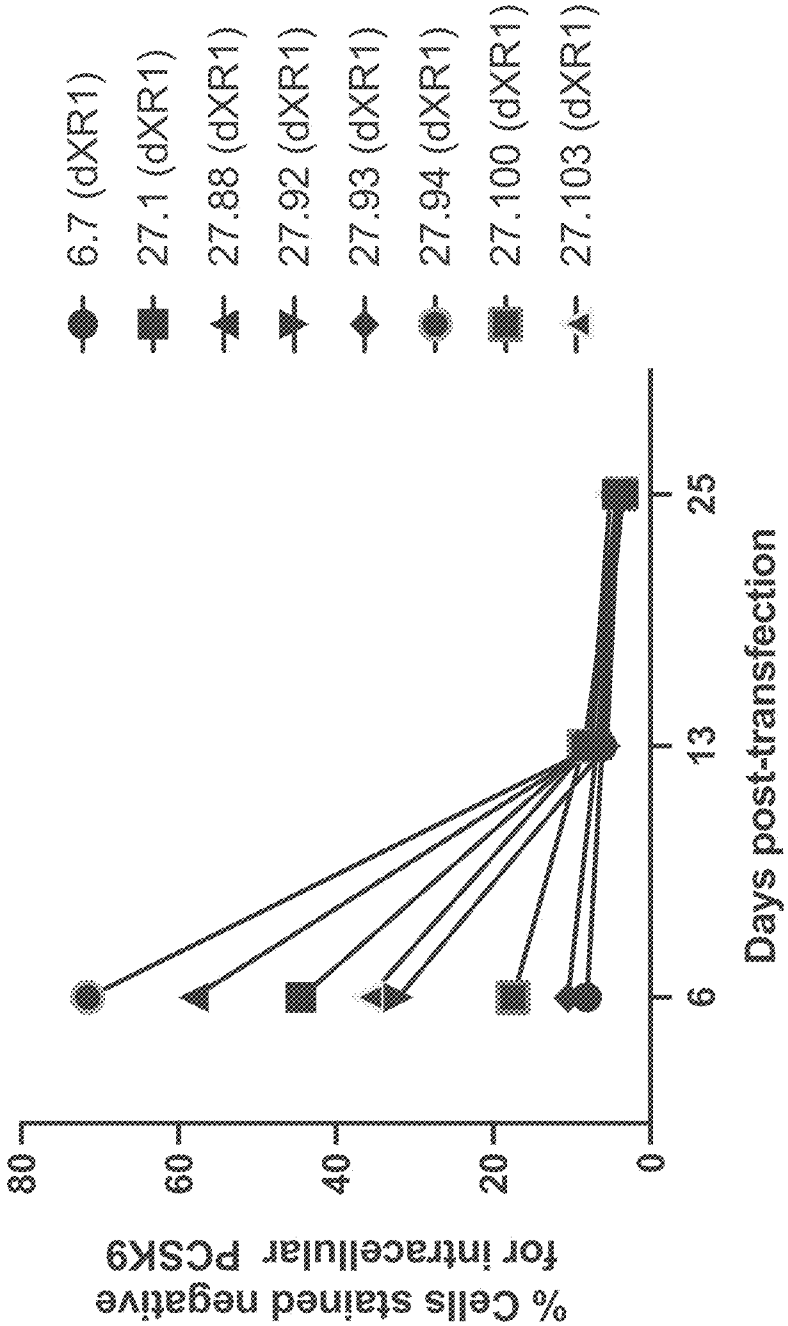
FIG. 5 is a time course plot showing the percentage of mouse Hepa1-6 cells, treated with dXR1 mRNA paired with the indicated PCSK9-targeting gRNAs, that stained negative for intracellular PCSK9 at 6, 13, and 25 days post-delivery, as described in Example 2. Spacer 6.7 targeting the human PCSK9 locus served as a non-targeting control, and treatment with water served as a negative control.
Figure 6:
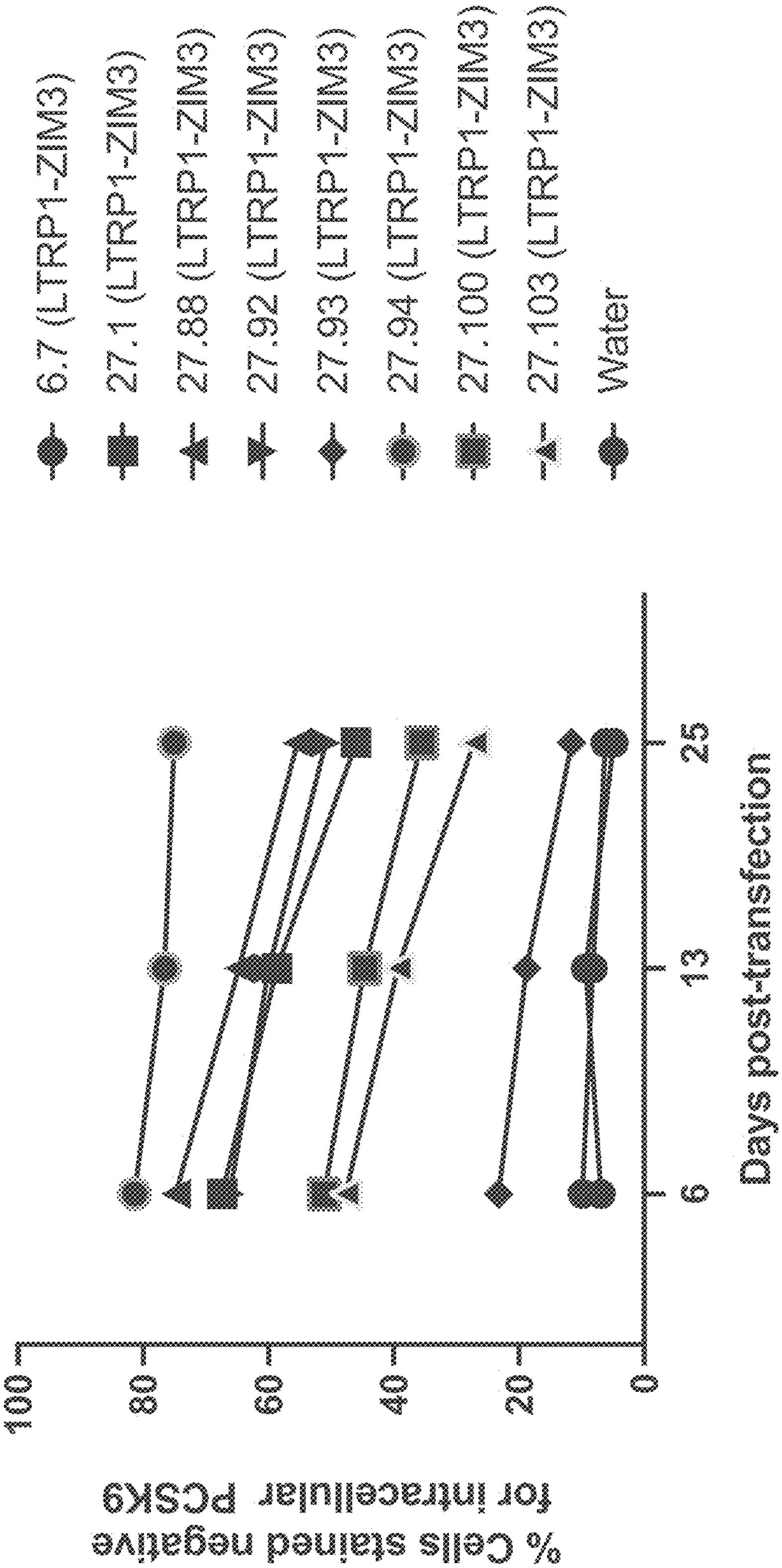
FIG. 6 is a time course plot showing the percentage of mouse Hepa1-6 cells, treated with LTRP1-ZIM3 mRNA paired with the indicated PCSK9-targeting gRNAs, that stained negative for intracellular PCSK9 at 6, 13, and 25 days post-delivery, as described in Example 2. Spacer 6.7 targeting the human PCSK9 locus served as a non-targeting control, and treatment with water served as a negative control.

In experiment #1, mRNAs encoding dXR1 or LTRP1-ZIM3 were co-transfected with a PCSK9-targeting gRNA into mouse Hepa1-6 cells to assess their ability to induce PCSK9 knockdown by silencing the mouse PCSK9 locus. The quantification of the resulting PCSK9 knockdown is shown in FIGS. 4-6. The data demonstrate that at day 6, use of six out of seven gRNAs targeting the mouse PCSK9 locus with LTRP1-ZIM3 mRNA resulted in >50% knockdown of intracellular PCSK9, with the leading spacer 27.94 achieving >80% repression level (FIG. 4). A similar trend was observed with use of dXR1 mRNA at day 6, although the degree of repression was less substantial when paired with certain spacers, such as spacer 27.92 and 27.100 (FIG. 4). The results also demonstrate that use of LTRP1-ZIM3 mRNA led to sustained repression of the PCSK9 locus through at least 25 days, with use of the top two spacers 27.94 and 27.88 showing the strongest permanence in silencing PCSK9 (FIG. 6). However, the PCSK9 repression mediated by dXR1 that was observed at day 6 reverted to similar levels of PCSK9 as detected with the non-targeting control (spacer 6.7) by day 13; such transient repression was noticeable for all gRNAs assayed that targeted the PCSK9 gene (FIG. 5).

Figure 7:
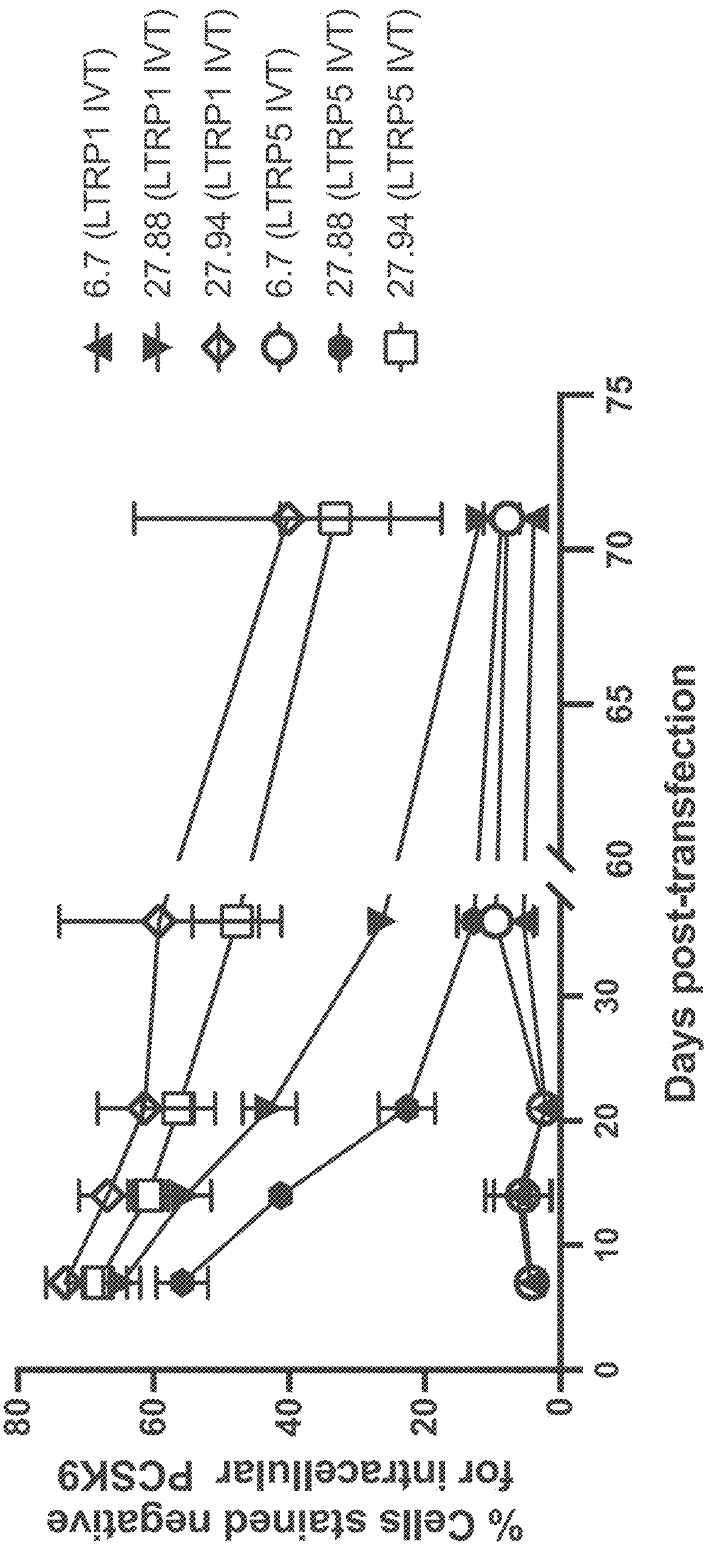
FIG. 7 is a time course plot showing the percentage of mouse Hepa1-6 cells, treated with IVT-produced LTRP1-ZIM3 vs. LTRP5-ZIM5 mRNA paired with the indicated PCSK9-targeting gRNAs, that stained negative for intracellular PCSK9 at the indicated timepoints days post-delivery, as described in Example 2.
Figure 8:
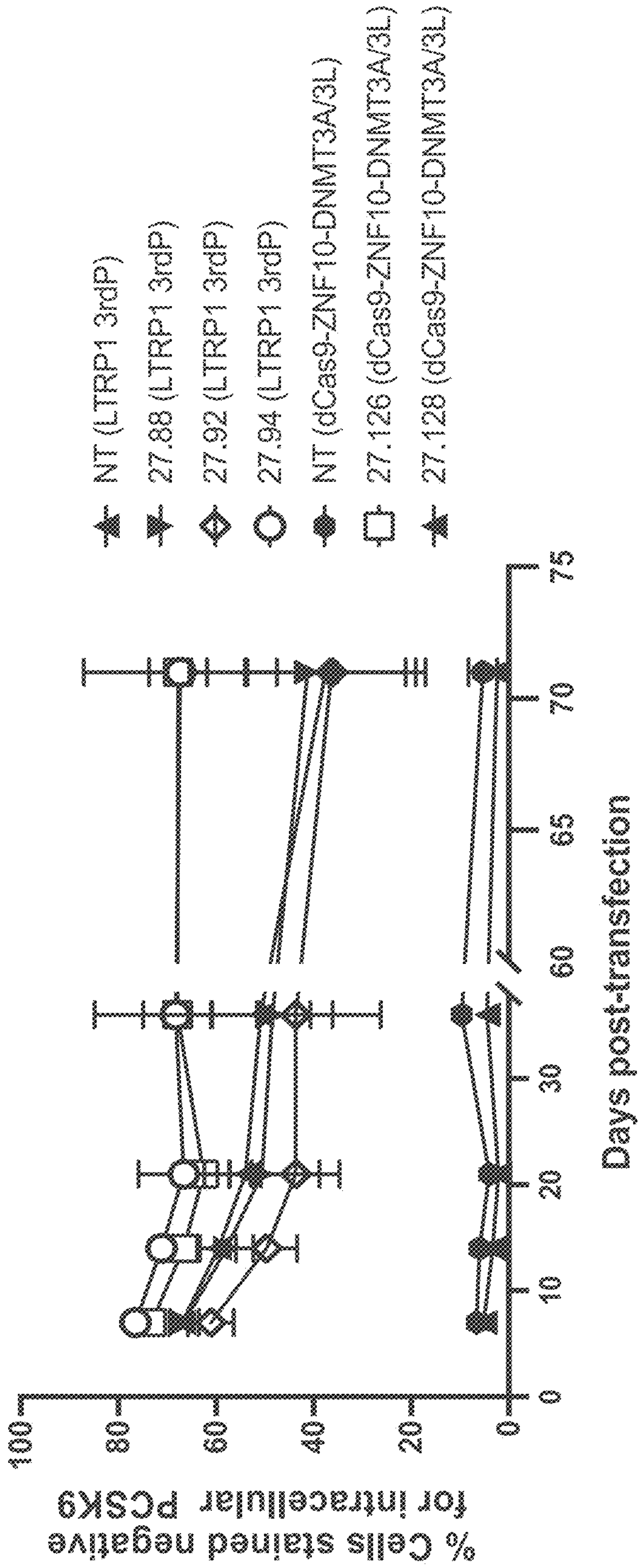
FIG. 8 is a time course plot showing the percentage of mouse Hepa1-6 cells, treated with third-party-produced LTRP1-ZIM3 vs. dCas9-ZNF10-DNMT3A/3L mRNA paired with the indicated PCSK9-targeting gRNAs, that stained negative for intracellular PCSK9 at the indicated timepoints post-delivery, as described in Example 2.

In experiment #2, mRNAs encoding LTRP1-ZIM3 or LTRP5-ZIM3, dCas9-ZNF10-DNMT3A/3L, or catalytically active CasX 491 were co-transfected with a PCSK9-targeting gRNA into mouse Hepa1-6 cells to assess their ability to induce PCSK9 knockdown by silencing the mouse PCSK9 locus. The quantification of the resulting PCSK9 repression is shown in FIGS. 7-8. The data demonstrate that delivery of IVT-produced LTRP1-ZIM3 or LTRP5-ZIM3 mRNA resulted in comparable levels of sustained PCSK9 knockdown when paired with a targeting gRNA with the top spacer 27.94 (~40% knockdown by day 71), while use of an alternative spacer 27.88 did not result in as effective of a sustained PCSK9 knockdown by day 71 (~12%) (FIG. 7). Furthermore, third-party-produced mRNA encoding LTRP1-ZIM3 and dCas9-ZNF10-DNMT3A/3L led to similar levels of durable PCSK9 knockdown when paired with gRNAs containing various spacers, with use of spacer 27.94 still resulting in the highest level of PCSK9 repression (FIG. 8).

These experiments demonstrate that LTRP molecules, having different configurations, can induce heritable silencing of an endogenous locus in a mouse liver cell line. Meanwhile, as anticipated, use of dXR constructs result in efficient repression of the target locus at early timepoints, but their use does not lead to durable silencing. These findings also show that dXR and LTRP molecules (of different configurations) can be delivered as mRNA and co-transfected with a targeting gRNA to cells, indicating that the transient nature of the delivered payload is still sufficient to induce silencing.

Example 3: Assessment of Spacers in Achieving Repression of the PCSK9 Locus in Human Hepatocyte Cells when Paired with an LTRP5-ADD Molecule Experiments were performed to demonstrate that multiple spacers with the TTC recognition motif, when paired with an LTRP molecule in configuration #5 (LTRP5; diagrammed in FIG. 2) containing the ADD domain, can induce durable repression of a therapeutically-relevant endogenous locus in human cells. Specifically, an initial proof-of-concept experiment was performed in human Huh7 cells to evaluate a subset of spacers that exhibit sequence conservation to the non-human primate (NHP) genome to identify leading spacers for testing in future in vivo NHP studies.

Materials and Methods

Computational Selection of PCSK9-Targeting Spacers for Experimental Testing with an LTRP5 Molecule Containing the ADD Domain:

To determine potential LTRP-specific spacers throughout the human PCSK9 locus, a target search region was defined as starting at 5 KB upstream of the transcription start site (TSS) through 5 KB downstream of the transcription stop site. Spacers were determined based on the availability of TTC PAMs; consequently, a total of 1,121 TTC spacers were identified throughout the target PCSK9 locus. These spacers were then functionally annotated by overlaying key genomic features based on their positioning, i.e., determining whether the putative spacer targeted an exon, an intron, or a candidate cis-regulatory element (cCRE), within the promoter region, and/or overlapped with a common site of genetic variation (e.g., SNPs). To narrow down and determine an initial group of spacers for experimental screening, the extracted spacers were subjected to a set of filtering criteria. Firstly, non-specific spacers were excluded by removing spacers with off-target sites that contain up to one base pair mismatch with the on-target site. Furthermore, spacers containing the following mononucleotide repeats were excluded: thymine nucleotide repeats greater than four base pairs (bp) in length or adenine, guanine, or cytosine nucleotide repeats greater than 5 bp in length. Next, from this filtered set, spacers with more than one off-target site containing mismatches in the last four nucleotides of the spacer were excluded. Lastly, spacers that targeted >2 KB upstream of the TSS and >2 KB downstream of the transcription stop site were excluded. This resulted in a filtered set of 722 TTC spacers (SEQ ID NO: 1824-2545). From this filtered set of 722 spacers, spacers that were TSS-proximal (within 1100 bp upstream and downstream of the TSS) were selected for experimental assessment, resulting in the identification of 67 TTC spacers. Two additional spacers, TG-06-354 and TG-06-352, positioned beyond the 1100 bp threshold window, were also selected for inclusion. The sequences of the resulting 69 TTC spacers are shown in Table 17.

TABLE 17

RNA sequences of the 69 TTC spacers targeting the human PCSK9 locus. Bolded spacers were spacers having sequence consensus between human and non-human primate genomes and were assessed in this example.

| Spacer ID | Spacer RNA sequence | SEQ ID NO: |
|---|---|---|
| TG-06-342 | AAUUACAGGCAACAGGAAGG | 1824 |
| TG-06-343 | CCCCAUGUAAGAGAGGAAGU | 1825 |
| TG-06-344 | CAGUUUCUGCCUCGCCGCGG | 1826 |
| TG-06-345 | GCCUCGCCGCGGCACAGGUG | 1827 |
| **TG-06-346** | **CCCACCUGUGCCGCGGCGAG** | **1828** |
| TG-06-347 | CUCCUUCACCCACCUGUGCC | 1829 |
| TG-06-348 | AGGCAUUCACUCCUUCACCC | 1830 |
| TG-06-349 | CUGUGCCUGGUGCAGUUCCC | 1831 |
| TG-06-350 | GUGUCAUAAAGAAAUUGCCU | 1832 |
| TG-06-351 | UUAUGACACAGAACUCAUGC | 1833 |
| **TG-06-001** | **GAGGAGGACGGCCUGGCCGA** | **1834** |
| **TG-06-002** | **ACCGCUGCGCCAAGGUGCGG** | **1835** |
| TG-06-004 | GCCAGGCCGUCCUCCUCGGA | 1836 |
| TG-06-005 | GUGCUCGGGUGCUUCGGCCA | 1837 |
| TG-06-117 | ACUUUGUUUGCAAAGACCUC | 1838 |
| TG-06-118 | GAGUGAAAUGGCCUGCUCUG | 1839 |
| TG-06-119 | GAGCAGGCCAUUUCACUCGG | 1840 |
| TG-06-120 | CUCGGAAUCUGCUGUGCAUC | 1841 |
| TG-06-121 | GGAAGGGCUGUCGAUACUGG | 1842 |
| TG-06-123 | UCCCAGUAUCGACAGCCCUU | 1843 |
| TG-06-124 | CAGUAUCGACAGCCCUUCCA | 1844 |
| TG-06-125 | AGAAAGAGCAAGCCUCAUGU | 1845 |
| TG-06-128 | AGAAAUCAACUGGACAAGCA | 1846 |
| **TG-06-131** | **UGAACAUGGUGUGUAAAAGG** | **1847** |
| **TG-06-132** | **AGAAGAUUCAAUUUGCAAAG** | **1848** |
| **TG-06-133** | **AUGGUAGGCACAAGCUCAGC** | **1849** |
| **TG-06-134** | **GAAUUCUAUGGUAGGCACAA** | **1850** |
| TG-06-135 | GGAAAGCUGAGCUUGUGCCU | 1851 |
| TG-06-138 | AGGGAUUUAUACUACAAAGA | 1852 |
| TG-06-139 | AGGAGCAGCUAGUUGGUAAG | 1853 |

TABLE 17-continued

RNA sequences of the 69 TTC spacers targeting the human PCSK9 locus. Bolded spacers were spacers having sequence consensus between human and non-human primate genomes and were assessed in this example.

| Spacer ID | Spacer RNA sequence | SEQ ID NO: |
|---|---|---|
| TG-06-140 | AAACUUAGCCUGGACCCCCU | 1854 |
| TG-06-141 | ACUGGCCUUAACCUGGCAGC | 1855 |
| TG-06-142 | UUCCACUGGCCUUAACCUGG | 1856 |
| TG-06-143 | GAAUCAAUCCUACUGUGGAC | 1857 |
| TG-06-144 | GUGGGCAGCGAGGAGUCCAC | 1858 |
| TG-06-145 | UGGGUCCACCUUGUCUCCUG | 1859 |
| **TG-06-146** | **GAAGUCUCACUGGUCAGCAG** | **1860** |
| **TG-06-147** | **GUGUUUCCUGGGUCCACCUU** | **1861** |
| TG-06-149 | AGCCCAGUUAGGAUUUGGGA | 1862 |
| TG-06-150 | UCCCUCUGCGCGUAAUCUGA | 1863 |
| TG-06-151 | CUCUGCGCGUAAUCUGACGC | 1864 |
| **TG-06-152** | **GCCUCGCCCUCCCCAAACAG** | **1865** |
| TG-06-153 | GUUAAUGUUUAAUCAGAUAG | 1866 |
| **TG-06-154** | **AGGGUGUGGGUGCUUGACGC** | **1867** |
| TG-06-155 | GCAGCGACGUCGAGGCGCUC | 1868 |
| TG-06-157 | GGGUCUGAGCCUGGAGGAGU | 1869 |
| TG-06-158 | GGAGCAGGGCGCGUGAAGGG | 1870 |
| TG-06-159 | GCGCGCCCCUUCACGCGCCC | 1871 |
| TG-06-160 | CGCGCCCUGCUCCUGAACUU | 1872 |
| TG-06-161 | GCUCCUGCACAGUCCUCCCC | 1873 |
| **TG-06-167** | **CACUGAAUAGCGCAGCCGCA** | **1874** |
| TG-06-168 | GUGGGAAGGUUCGCGGGGUU | 1875 |
| TG-06-169 | CGGGGUUGGGAGACCCGGAG | 1876 |
| TG-06-170 | UCGGCCUCCGGGUCUCCCAA | 1877 |
| TG-06-171 | CAGUACGUUCCAGGCAUUCA | 1878 |
| TG-06-172 | GCUGAAACAGAUGGAAUACU | 1879 |
| TG-06-249 | AAACCAAAUCGGAACCCACU | 1880 |
| HS-6-147 | UGUUGCCUGUAAUUGGAAUU | 1881 |
| HS-6-149 | CCUUCCUGUUGCCUGUAAUU | 1882 |
| TG-06-122 | CCUUUGUUUCUUCCCAGUAU | 1883 |
| TG-06-127 | UCCUCCUGCCUGGUACACAA | 1884 |
| TG-06-137 | GAAUGUACCUAUAUGACGUC | 1885 |
| TG-06-188 | CCCCGGCCUCCCAUCCCUAC | 1886 |
| **TG-06-243** | **CUUGGCACGAUCUUGGGGAC** | **1887** |
| TG-06-250 | GAUUUGGUUUGGAAAACAUG | 1888 |
| TG-06-251 | CUCCAGGCCCUCCACCCUCC | 1889 |
| HS-6-159 | CACCCCGCCCCUGUCUCGGG | 1890 |
| **TG-06-354** | **CCCCUGCCCCUUCAGCUGGU** | **1925** |
| **TG-06-352** | **UCCCUCACCAAUUACCCCUC** | **1910** |

Note, for spacer nomenclature throughout these Examples, dashes and periods are used interchangeably. Thus, spacer "06-146" is the same as spacer "6.146."

Assessment of PCSK9 Secretion Levels for Select PCSK9-Targeting Spacers Having Sequence Conservation with the Non-Human Primate Genome:

Of the 69 TTC spacers identified, 15 spacers that exhibited sequence conservation between human and non-human primate genomes (bolded spacers in Table 17) were initially tested to assess their effect on PCSK9 secretion levels.

mRNA encoding the following molecules were generated by IVT following similar methods as described in Example 2:1) a catalytically-active CasX 676 (as described in Example 5), 2) dXR1 (as described in Example 2), and 3) LTRP5-ADD-ZIM3 (as described in Example 4). The DNA and mRNA sequences for CasX 676 are shown in Tables 21 and 22; the DNA and mRNA sequences for dXR1 are shown in Tables 11 and 12; the DNA and mRNA sequences for LTRP5-ADD-ZIM3 are shown in Tables 18 and 19.

gRNAs containing NHP-conserved spacers targeting the PCSK9 locus (bolded spacers in Table 17) were designed using gRNA scaffold 316 and chemically synthesized. Furthermore, a B2M-targeting gRNA was used as a non-targeting control, while spacer TG-06-138 (also known as spacer 6.138; SEQ ID NO: 1852) was used to pair with dXR1, and spacer TG-06-001 (also known as spacer 6.1; SEQ ID NO: 1834) was used to pair with CasX 676. Spacer TG-06-157 (also known as spacer 6.157; SEQ ID NO: 1869), which is not an NHP-conserved spacer, was included as a positive control given its demonstrated efficacy in sustaining repression of the PCSK9 locus, which is shown in Example 5, below.

To assess PCSK9 secretion, seeded Huh7 cells were transfected with mRNA encoding a catalytically-active CasX 676, dXR1, or LTRP5-ADD-ZIM3 and a gRNA with scaffold 316 and spacer targeting either the B2M or PCSK9 locus. Media supernatant was harvested at 6, 18, 36, and 87 days post-transfection to assess level of PCSK9 secretion by ELISA. Levels of PCSK9 secretion were normalized to total cell count. As an additional control, PCSK9 secretion was also measured in the media supernatant harvested from wells containing untreated, naïve cells.

Results

Figure 9:
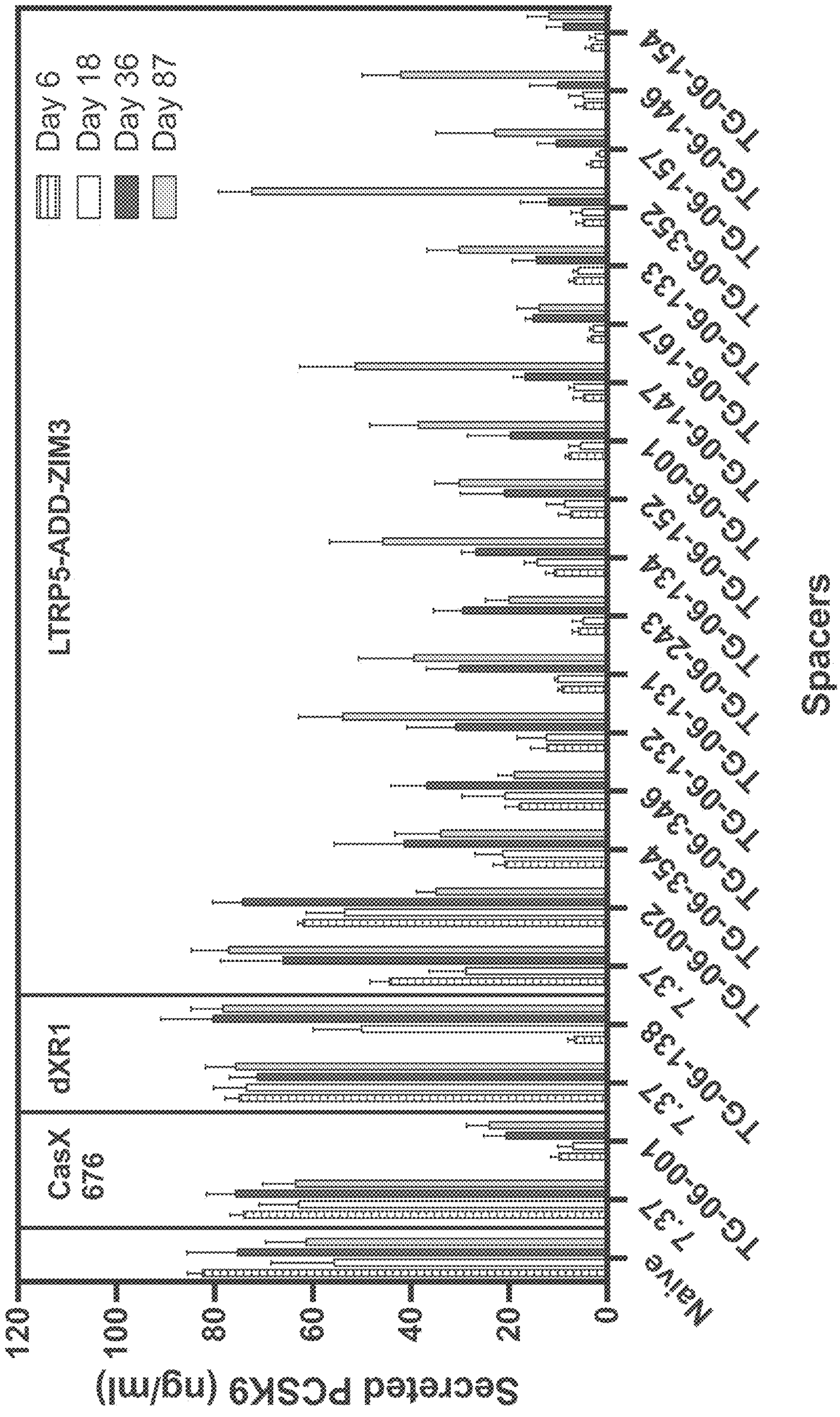
FIG. 9 is a bar graph showing the quantification of secreted PCSK9 levels at 6, 18, 36, and 87 days post-transfection in Huh7 cells lipofected with mRNA encoding for CasX 676, dXR1, or LTRP5-ADD-ZIM3 when paired with the indicated targeting gRNAs, as described in Example 3. Secreted PCSK9 levels were normalized to total cell count. Naïve, untreated cells served as an experimental control.

Quantification of normalized PCSK9 secretion level for Huh7 cells transfected with mRNA encoding catalytically-active CasX 676, dXR1, or LTRP5-ADD-ZIM3 with an NHP-conserved gRNA targeting the PCSK9 locus at the four timepoints is shown FIG. 9. The data demonstrate that use of most NHP-conserved spacers with LTRP5-ADD- ZIM3 resulted in sustained repression through 36 days post-transfection when compared with control conditions, i.e., naïve, untreated cells, cells treated with dXR1, and cells treated with the non-targeting control (using spacer 7.37 targeting the B2M locus). Specifically, in comparison to the PCSK9 secretion level observed with use of spacer 6.1 paired with CasX 676, use of TSS-proximal spacers TG-06-147, TG-06-167, TG-06-133, TG-06-146, and TG-06-154 paired with LTRP5-ADD-ZIM3 resulted in similar or further reduced level of sustained repression through day 36 (FIG. 9). Interestingly, use of TG-06-352, which is positioned beyond the 1100 bp threshold window designated here as "TSS-proximal", also resulted in effective repression through day 36 (FIG. 9). Similar to the findings observed in Example 5, treatment with LTRP5-ADD-ZIM3 with spacer 6.157 resulted in sustained repression of secreted PCSK9 levels, while treatment with dXR1 and spacer 6.138 resulted in transient repression. Furthermore, treatment with any of the three mRNA molecules with spacer 7.37 targeting the B2M locus did not affect PCSK9 secretion (FIG. 9). However, by 87 days post-transfection, only use of spacers TG-06-157, TG-06-154, TG-06-167, and TG-06-243 paired with LTRP5-ADD-ZIM3 resulted in similar or further reduced level of sustained repression when compared to use of spacer 6.1 paired with CasX 676 (FIG. 9).

These results demonstrate that delivery of mRNA encoding an LTRP molecule with the ADD domain with the appropriate PCSK9-targeting gRNA can result in sustained repression of an endogenous target locus in human cells. Furthermore, these experiments revealed that several human spacers having consensus sequence with the non-human primate species achieved strong phenotypic effects from targeting a therapeutically-relevant locus, supporting the potential use of these select spacers in preclinical efficacy studies utilizing non-human primate models.

Example 4: Demonstration that Inclusion of the ADD Domain into an LTRP Molecule Enhances Repression of an Endogenous Locus in Mouse Hepa1-6 Cells Experiments were performed to demonstrate that incorporation of the ADD domain into an LTRP molecule enhances the ability of LTRPs to induce durable repression of an endogenous locus in mouse Hepa1-6 liver cells, when delivered as mRNA co-transfected with a targeting gRNA.

Materials and Methods

Generation of LTRP #5 mRNA:

mRNA encoding two variants of the LTRP #5 molecule were generated by in vitro transcription (IVT): 1) an LTRP #5 molecule containing the ZIM3-KRAB domain (hereafter known as LTRP5-ZIM3) and 2) a LTRP5-ZIM3 containing the DNMT3A-ADD domain (hereafter known as LTRP5-ADD-ZIM3). Briefly, constructs encoding for a 5'UTR region, LTRP5-ZIM3 or LTRP5-ADD-ZIM3 with flanking SV40 NLSes, and a 3'UTR region were generated and cloned into a plasmid containing a T7 promoter and 79-nucleotide poly(A) tail. Sequences encoding the LTRP5-ZIM3 or LTRP5-ADD-ZIM3 molecules were codon-optimized using a codon utilization table, in addition to using a publicly available codon optimization tool and adjusting parameters such as GC content as needed. The DNA sequences encoding the LTRP5-ZIM3 and LTRP5-ADD-ZIM3 mRNAs are listed in Table 18. The corresponding mRNA sequences and protein sequences are listed in Table 19 and Table 20 respectively.

TABLE 18

Encoding DNA and RNA sequences of the LTRP5-ZIM3 and LTRP5-ADD-ZIM3 mRNA molecules assessed in this example*.

| LTRP molecule | Component | DNA sequence or SEQ ID NO | RNA sequence or SEQ ID NO |
|---|---|---|---|
| LTRP5-ZIM3 | 5'UTR | 3047 | 3115 |
| | START codon + NLS + linker | 3104 | 3116 |
| | START codon + DNMT3A catalytic domain | 3059 | 3117 |
| | Linker | 3060 | 3118 |
| | DNMT3L interaction domain | 3061 | 3119 |
| | Linker | 3105 | 3105 |
| | ZIM3-KRAB | 3051 | 3120 |
| | Linker | 3106 | 3121 |
| | dCasX491 | 3049 | 3122 |
| | Buffer + linker | 3107 | 3123 |
| | NLS + STOP codon + buffer sequence | 3108 | 3124 |
| | 3'UTR | 3055 | 3125 |
| | Buffer sequence | TCTAG | UCUAG |
| | Poly(A) tail | 3109 | 3109 |
| LTRP5-ADD-ZIM3 | 5'UTR | 3047 | 3115 |
| | START codon + NLS + linker | 3104 | 3116 |
| | START codon + DNMT3A ADD domain | 3111 | 3127 |
| | DNMT3A catalytic domain | 3112 | 3128 |
| | Linker | 3060 | 3118 |
| | DNMT3L interaction domain | 3061 | 3119 |
| | Linker | 3105 | 3105 |
| | ZIM3-KRAB | 3051 | 3120 |
| | Linker | 3106 | 3121 |
| | dCasX491 | 3049 | 3122 |
| | Buffer + linker | 3107 | 3123 |
| | NLS + STOP codon + buffer sequence | 3108 | 3124 |

TABLE 18-continued

Encoding DNA and RNA sequences of the LTRP5-ZIM3 and LTRP5-ADD-ZIM3 mRNA molecules assessed in this example*.

| LTRP molecule | Component | DNA sequence or SEQ ID NO | RNA sequence or SEQ ID NO |
|---|---|---|---|
| | 3'UTR | 3055 | 3125 |
| | Buffer sequence | 3056 | 3126 |
| | Poly(A) tail | 3109 | 3109 |

*Components are listed in a 5' to 3' order within the constructs

TABLE 19

Full-length RNA sequences of LTRP5-ZIM3 and LTRP5-ADD-ZIM3 mRNA molecules assessed in this example. Modification 'mψ' = N1-methyl-pseudouridine.

| LTRP molecule | SEQ ID NO | RNA Sequence |
|---|---|---|
| LTRP5-ZIM3 | 3129 | AAAmψAAGAGAGAAAAGAAGAGmψAAGAAGAAAmψAmψAAGAGCCACCAmψGGC<br>CCCmψAAGAAGAAGCGmψAAAGmψGAGCCGGAmψGAACCACGACCAGGAGmψmψ<br>CGACCCCCCmψAAGGmψGmψACCCmψCCCGmψCCCCGCCGAGAAGAGAAAGCCC<br>AmψCCGGGmψCCmψGAGCCmψGmψmψCGAmψGGCAmψCGCCACCGGmψCmψGCm<br>ψGGmψGCmψGAAGGACCmψGGGCAmψCCAGGmψGGAmψAGGmψACAmψmψGCCm<br>ψCCGAGGmψGmψGCGAGGACmψCCAmψCACCGmψGGGAAmψGGmψGCGmψCAmψ<br>CAGGGCAAGAmψCAmψGmψACGmψGGGCGACGmψGCGGAGCGmψGACACAGAAG<br>CAmψAmψCCAGGAGmψGGGGCCCmψmψmψCGACCmψGGmψGAmψCGGCGGCAGC<br>CCmψmψGCAAmψGACCmψGAGCAmψCGmψGAACCCAGCCCGGAAGGGCCmψGmψ<br>ACGAGGGAACCGGCAGACmψGmψmψCmψmψCGAGmψmψmψmψACAGACmψGCmψ<br>GCACGACGCCCGGCCmψAAGGAAGGCGACGACCGGCCCmψmψCmψmψmψmψGGC<br>mψGmψmψCGAGAAmψGmψGGmψGGCCAmψGGGAGmψCAGCGACAAGCGGGAmψA<br>mψmψAGCCGGmψmψCCmψGGAGAGCAACCCCGmψGAmψGAmψCGAmψGCCAAGG<br>AAGmψGAGCGCCGCCCACCGGGCCAGAmψACmψmψCmψGGGGCAAmψCmψGCCm<br>ψGGCAmψGAACAGACCCCmψGGCCAGCACCGmψGAACGACAAGCmψGGAGCmψG<br>CAGGAGmψGCCmψGGAGCACGGCCGGAmψCGCCAAGmψmψCAGCAAGGmψGAGA<br>ACCAmψCACCACCCGAAGCAACAGCAmψCAAACAAGGCAAGGACCAGCACmψmψ<br>mψCCmψGmψGmψmψCAmψGAAGCAGAAGGAGGACAmψCCmψGmψGGmψGmψACC<br>GAGAmψGGAGAGAGmψGmψmψCGGGmψmψCCCAGmψCCACmψACACAGAmψGmψ<br>CAGCAACAmψGmψCmψAGACmψGGCCAGACAGAGACmψGCmψGGGAAGAAGCmψ<br>mψACmψmψCGCCmψGCGmψGAGCAGCGGCAACAGCAACGCCAACAGCCGGGGCC<br>CCAGCmψmψCmψCmψAGCGGCCmψGGmψGCCACmψGmψCCCmψGAGAGGGAGCC<br>ACAmψGGGCCCCAmψGGAGAmψCmψACAAAACCGmψGAGCGCCmψGGAAGCGGC<br>AGCCmψGmψGCGCGmψGCmψGAGCCmψGmψmψmψCGGAAmψAmψCGAmψAAAGm<br>ψCCmψGAAAAGCCmψGGGAmψmψCCmψGGAGAGCGGCmψCmψGGCmψCCGGCGG<br>mψGGCACCCmψGAAGmψACGmψGGAGGAmψGmψGACAAACGmψGGmψCAGACGG<br>GAmψGmψGGAGAAGmψGGGGCCCCmψmψCGAmψCmψGGmψGmψACGGCAGCACC<br>CAACCCCmψGGGCAGCmψCmψmψGmψGACCGGmψGCCCmψGGCmψGGmψACAmψ<br>Gmψmψmψ CAGmψmψCCACCGGAmψCCmψGCAGmψACGCCCmψGCCGAGACAGGA<br>GmψCCCAGCGGCCSmψmψCmψmψmψmψGGAmψmψmψmψCAmψGGACAACmψmψG<br>CmψGCmψGACCGAGGAmψGACCAGGAAACmψACCACmψCGGmψmψCCmψGCAGA<br>CCGAAGCCGmψGACCCmψGCAGGACGmψGAGAGGCCGGGACmψACCAGAACGCC<br>AmψGCGGGmψGmψGGmψCCAACAmψCCCmψGGACmψGAAAAGCAAGCACGCACC<br>mψCmψGACCCCmψAAAGAAGAGGAGmψACCmψGCAGGCCCAGGmψGCGGAGCAG<br>AAGCAAGCmψGGACGCCCCmψAAGGmψGGAmψCmψGCmψGGmψGAAGAAmψmψG<br>CCmψCCmψGCCCCmψGAGAGAGmψACmψmψCAAGmψAmψmψmψCAGCCAGAAmψ<br>AGmψCmψGCCCCmψGGGAGGCAGCGGCGGCGGCAmψGAACAACmψCCCAGGGCA<br>GAGmψGACCmψmψCGAGGACGmψGACCGmψGAAmψmψmψmψACACAGGGAGAGm<br>ψGGCAGAGACmψGAACCCCGAGCAGAGAAACCmψGmψACCGGGAmψGmψGAmψG<br>CmψGGAAAACmψACAGCAAmψCmψGGmψGmψCCGmψGGGCCAGGGCGAGACCAC<br>AAAGCCmψGACGmψGAmψCCmψGCGmψCmψGGAGCAGGGCAAGGAACCCmψGGC<br>mψGGAGGAGGAGGAGGmψGCmψGGGAAGCGGACGGGCCGAGAAGAACGGCGACA<br>mψCGGCGGACAGAmψCmψGGAAGCCmψAAGGACGmψGAAAGAAAGCCmψGGGCG<br>GCCCAAGCAGCGGCGCCCCmψCCmψCCCAGCGGCGGCAGCCCAGCCGGCmψCCC<br>CAACCmψCmψACCGAGGAGGGCACCmψCmψGAGmψCCGCCACCCCCGAGAGCGG<br>CCCmψGGCACCmψCCACCGAGCCCAGCGAGGGCAGCGCACCCGGCAGCCCmψGC<br>CGGCAGCCCCACCmψCCACAGAGGAGGGAACCAGCACCGAGCCCAGCGAAGGCA<br>GCGCCCCAGGCACCAGCACCGAGCCmψAGmψGAGCAGGAGAmψmψAAACGGAmψ<br>CAACAAGAmψCAGAAGAAGACmψmψGmψGAAAGACAGCAACACCAAGAAGGCCG<br>GCAAGACAGGCCCCAmψGAAAACCCmψGCmψGGmψmψAGAGmψGAmψGACACCC |

TABLE 19-continued

Full-length RNA sequences of LTRP5-ZIM3 and LTRP5-ADD-ZIM3 mRNA molecules assessed in this example. Modification 'mψ' = N1-methyl-pseudouridine.

| LTRP molecule | SEQ ID NO | RNA Sequence |
|---|---|---|
| | | GAmψCmψGAGAGAGCGGCmψGGAAAACCmψGAGAAAGAAGCCmψGAAAAmψAmψ<br>CCCCCAGCCCAmψCAGCAAmψACAmψCmψAGAGCCAACCmψGAAmψAAGCmψGC<br>mψGACCGAmψmψACACCGAAAmψGAAGAAGGCGAmψCCmψGCAmψGmψGmψACm<br>ψGGGAAGAGmψmψCCAGAAGGACCCmψGmψGGGCCmψGAmψGAGCCGGGmψGGC<br>CCAGCCmψGCCAGCAAGAAGAmψCGAmψCAGAACAAGCmψGAAACCmψGAGAmψ<br>GGACGAGAAGGGCAACCmψGACCACCGCCGGCmψmψmψGCCmψGCmψCmψCAGm<br>ψGmψGGCCAGCCCCmψGmψmψCGmψGmψACAAGCmψGGAGCAGGmψGmψCmψGA<br>GAAGGGCAAGGCmψmψACACCAACmψACmψmψCGGACGGmψGCAAmψGmψGGCC<br>GAGCACGAAAAGCmψGAmψCCmψGCmψGGCCCAGCmψGAAGCCCGAGAAGGAmψ<br>AGCGACGAAGCCGmψGACAmψAmψAGCCmψGGGAAAGmψmψmψGGGCAGAGGGC<br>CCmψGGAmψmψmψCmψACAGCAmψmψCAmψGmψGACCAAGGAGmψCCACCCACC<br>CCGmψGAAGCCCCmψGGCCCAGAmψCGCCGGAAACAGAmψACGCCmψCCGGACC<br>mψGmψGGGAAAGGCCCmψGAGCGACGCAmψGmψAmψGGGCACAAmψCGCCmψCC<br>mψmψCCmψGmψCmψAAGmψACCAGGACAmψCAmψCAmψCGAACACCAGAAGGmψ<br>GGmψGAAGGGCAACCAGAAGAGACmψGGAGAGCCmψGCGGGAGCmψGGCCGGCA<br>AGGAAAACCmψGGAAmψACCCmψAGCGmψGACCCmψGCCACCmψCAGCCmψCAC<br>ACCAAGGAGGGCGmψmψGAmψGCCmψACAACGAAGmψGAmψCGCCCGGGmψGCG<br>AAmψGmψGGGmψGAACCmψGAACCmψGmψGGCAGAAGCmψGAAGCmψAAGCAGA<br>GAmψGAmψGCCAAGCCmψCmψGCmψGAGACmψGAAGGGAmψmψCCCmψmψCCmψ<br>mψmψCCmψCmψGGmψCGAGAGACAGGCCAACGAAGmψGGACmψGGmψGGGACAm<br>ψGGmψGmψGmψAACGmψGAAGAAGCmψGAmψCAACGAGAAAAAGGAGGAmψGGC<br>AAGGmψGmψmψmψmψGGCAGAAmψCmψGGCmψGGCmψACAAGAGACAGGAAGCC<br>CmψGAGACCAmψACCmψGAGCAGCGAGGAAGAmψCGGAAGAAGGGAAAGAAAmψ<br>mψCGCmψCGGmψACCAGCmψGGGCGACCmψGCmψGCmψGCACCmψGGAAAAGAA<br>GCACGGCGAGGACmψGGGGAAAGGmψGmψACGACGAGGCCmψGGGAGCGGAmψm<br>ψGACAAGAAAGmψGGAAGGCCmψGAGCAAGCACAmψCAAGCmψGGAAGAGGAAC<br>GGAGAAGCGAGGACGCCCAGAGCAAGGCCGCCCmψGACCGACmψGGCmψGCGGG<br>CmψAAGGCCAGCmψmψCGmψGAmψCGAGGGCCmψGAAGGAGGCCGACAAGGACG<br>AGmψmψCmψGCAGAmψGCGAGCmψGAAGCmψGCAGAAGmψGGmψACGGGGACCm<br>ψGCGGGGAAAGCCCmψmψCGCCAmψCGAAGCCGAGAACAGCAmψCCmψGGACAm<br>ψCAGCGGCmψmψCAGCAAGCAGmψACAACmψGmψGCCmψmψCAmψCmψGGCAGA<br>AGGACGGCGmψGAAGAAGCmψGAACCmψGmψACCmψGAmψCAmψCAACmψACmψ<br>mψCAAGGGCGGCAAGCmψGCGGmψmψCAAGAAGAmψCAAACCmψGAAGCCmψmψ<br>CGAAGCCAACAGAmψmψCmψACACCGmψGAmψCAACAAAAAGAGCGGCGAGAmψ<br>CGmψGCCCAmψGGAGGmψGAACmψmψCAACmψmψCGACGACCCCAACCmψGAmψ<br>CAmψCCmψGCCmψCmψGGCCmψmψmψGGCAAGAGACAGGGCAGAGAAmψmψCAm<br>ψCmψGGAACGACCmψGCmψGmψCCCmψGGAAACCGGCAGCCmψGAAGCmψGGCC<br>AACGGAAGAGmψGAmψCGAGAAGACACmψGmψACAACAGAAGAACCCGGCAGGA<br>mψGAGCCmψGCCCmψGmψmψCGmψGGCCCmψGACCmψmψCGAGCGGCGGGAGGm<br>ψCCmψGGACmψCCmψAmψCCAAAmψAmψCAAAmψGAACCmψGAmψCGGCGmψGG<br>CAAGAGGCGAAAACAmψCCCCGCCGmψGAmψCGCCCmψGACCGACCCCGAGGGC<br>mψGCCCACmψGAGCCGGmψmψmψAAGGAmψAGCCmψGGGAAACCCAACCCACAm<br>ψCCmψGAGAAmψCGGCGAGAGCmψAmψAAGGAGAAGCAGCGGACCAmψCCAGGC<br>CAAGAAGGAGGmψGGAGCAGCGGAGAGCCGGCGGCmψACAGCCGGAAGmψACGC<br>CAGCAAAGCCAAGAAmψCmψGGCAGACGAmψAmψGGmψGAGAAACACCGCmψAG<br>AGAmψCmψGCmψGmψACmψACGCCGmψGACCCAGGAmψGCCAmψGCmψGAmψCm<br>ψmψCGCCAACCmψGAGCCGGGGCmψmψCGGCCGGCAGGGCAAGCGGACCmψmψC<br>AmψGGCCGAGAGACAGmψACACACGGAmψGGAGGACmψGGCmψGACCGCCAAGC<br>mψGGCCmψACGAGGGCCmψGAGCAAGACCmψACCmψGmψCCAAGACACmψGGCC<br>CAGmψACACCmψCCAAGACAmψGCAGCAACmψGmψGGGmψmψmψACCAmψCACC<br>AGCGCCGACmψACGACAGGGmψGCmψGGAGAAGCmψGAAGAAGACAGCAACAGG<br>CmψGGAmψGACCACAAmψmψAACGGCAAGGAGCmψGAAGGmψGGAGGGCCAGAm<br>ψmψACCmψACmψACAACAGAmψACAAGAGACAGAACGmψAGmψCAAGGACCmψG<br>mψCCGmψCGAGCmψGGAmψAGACmψGAGCGAAGAAmψCmψGmψGAACAACGACA<br>mψCmψCCmψCCmψGGACAAAGGGCAGAAGCGGAGAAGCmψCmψGAGCCmψCCmψ<br>GAAGAAAAGAmψmψCmψCCCAmψAGACCCGmψGCAGGAGAAGmψmψCGmψGmψG<br>CCmψGAACmψGCGGCmψmψCGAGACACACGCAGCCGAGCAAGCCGCCCmψGAAC<br>AmψCGCCAGAmψCCmψGGCmψGmψmψCCmψGCGGAGCCAGGAGmψACAAGAAAm<br>ψACCAGACAAACAAGACAACCGGCAACACCGAmψAAGAGAGCCmψmψCGmψCGA<br>GACCmψGGCAGmψCCmψmψmψmψACCGGAAGAAGCmψmψAAGGAGGmψGmψGGA<br>AACCmψGCCGmψGCGGmψCmψGGCGGAmψCmψGGCGGAGGCmψCCACCAGCCCC<br>AAGAAAAAGAGAAAAGmψCmψAAmψAGAmψAAGCmψGCCmψmψCmψGCGGGGCm<br>ψmψGCCmψmψCmψGGCCAmψGCCCmψmψCmψmψCmψCmψCCCmψmψGCACCmψG<br>mψACCmψCmψmψGGmψCmψmψmψGAAmψAAAGCCmψGAGmψAGGAAGmψCmψAG<br>AAAAAAAAAAAAAAAAAAAAAAAAAAAAAAAAAAAAAAAAAAAAAAAAAA<br>AAAAAAAAAAAAAAAAAAAAAAA |
| LTRP5-ADD-ZIM3 | 3130 | AAAmψAAGAGAGAAAAGAAGAGmψAAGAAGAAAmψAmψAAGAGCCACCAmψGGC<br>CCCmψAAGAAGAAGCGmψAAAGmψGAGCCGGAmψGGAACGCCmψCGmψCmψACG<br>AGGmψGCGGCAGAAGmψGCAGAAACAmψCGAGGACAmψCmψGCAmψCmψCCmψG<br>CGGAmψCmψCmψGAACGmψGACCCmψGGAGCACCCACmψGmψmψCAmψCGGCGG<br>CAmψGmψGCCAGAACmψGmψAAAAACmψGmψmψmψmψCmψGGAGmψGmψGCCmψ |

TABLE 19-continued

Full-length RNA sequences of LTRP5-ZIM3 and LTRP5-ADD-ZIM3 mRNA molecules assessed in this example.
Modification 'mψ' = N1-methyl-pseudouridine.

| LTRP molecule | SEQ ID NO | RNA Sequence |
|---|---|---|
| | | AmψCAAmψACGACGAmψGACGGCmψACCAGAGCmψACmψGCACCAmψCmψGmψm<br>ψGCGGCGGAAGAGAGGmψGCmψGAmψGmψGmψGGAAAmψAACAACmψGCmψGCC<br>GGmψGCmψmψCmψGCmψGGGAAmψGCGmψGGACCmψGCmψGGmψGGGCCCCGGC<br>GCCGCCCAGGCCGCmψAmψmψAAGGAAGAmψCCmψmψGGAACmψGCmψACAmψG<br>mψGCGGCCACAAGGGCACAmψACGGCCmψGCmψGAGACGGAGAGAGGACmψGGC<br>CmψAGCAGACmψGCAGAmψGmψmψCmψmψCGCCAAmψAACCACGACCAGGAGmψ<br>mψCGACCCCCCmψAAGGmψGmψACCCmψCCCGmψCCCCGCCGAGAAGAGAAAGC<br>CCAmψCCGGGmψCCmψGAGCCmψGmψmψCGAmψGGCAmψCGCCACCGGmψCmψG<br>CmψGGmψGCmψGAAGGACCmψGGGCAmψCCAGGmψGGAmψAGGmψACAmψmψGC<br>CmψCCGAGGmψGmψGCGAGGACmψCCAmψCACCGmψGGGAAmψGGmψGCGmψCA<br>mψCAGGGCAAGAmψCAmψGmψACGmψGGGCGACGmψGCGGAGCGmψGACACAGA<br>AGCAmψAmψCCAGGAGmψGGGGCCCmψmψmψCGACCmψGGmψGAmψCGGCGGCA<br>GCCCmψmψGCAAmψGACCmψGAGCAmψCGmψGAACCCAGCCCGGAAGGGCCmψG<br>mψACGAGGGAACCGGCAGACmψGmψmψCmψmψCGAGmψmψmψmψACAGACmψGC<br>mψGCACGACGCCCGGCCmψAAGGAAGGCGACGACCGGCCCmψmψCmψmψmψmψG<br>GCmψGmψmψCGAGAAmψGmψGGmψGGCCAmψGGGAGmψCAGCGACAAGCGGGAm<br>ψAmψmψAGCCGGmψmψCCmψGGAGAGCAACCCCGmψGAmψGAmψCGAmψGCCAA<br>GGAAGmψGAGCGCCGCCCACCGGGCCAGAmψACmψmψCmψGGGGCAAmψCmψGC<br>CmψGGCAmψGAACAGACCCCmψGGCCAGCACCGmψGAACGACAAGCmψGGAGCm<br>ψGCAGGAGmψGCCmψGGAGCACGGCCGGAmψCGCCAAGmψmψCAGCAAGGmψGA<br>GAACCAmψCACCACCCGAAGCAACAGCAmψCAAACAAGGCAAGGACCAGCACmψ<br>mψmψCCmψGmψGmψmψCAmψGAACGAGAACCAGGACAmψCCmψGmψGGmψGmψA<br>CCGAGAmψGGAGAGAGmψGmψmψCGGGmψmψCCCAGmψCCACmψACACAGAmψG<br>mψCAGCAACAmψGmψCmψAGACmψGGCCAGACAGAGACmψGCmψGGGAAGAAGC<br>mψGGmψCCGmψCCCmψGmψGAmψCAGACACCmψGmψmψCGCCCCmψCmψGAAGG<br>AGmψACmψmψCGCCmψGCGmψGAGCAGCGGCAACAGCAACGCCAACAGCCGGGG<br>CCCCAGCmψmψCmψCmψAGCGGCCmψGGmψGCCACmψGmψCCCmψGAGAGGGAG<br>CCACAmψGGGCCCCAmψGGAGAmψCmψACAAAACCGmψGAGCGCCmψGGAAGCG<br>GCAGCCmψGmψGCGCGmψGCmψGAGCCmψGmψmψmψCGGAAmψAmψCGAmψAAA<br>GmψCCmψGAAAAGCCmψGGGAmψmψCCmψGGAGAGCGGCmψCmψGGCmψCCGGC<br>GGmψGGCACCCmψGAAGmψACGmψGGAGGAmψGmψGACAAACGmψGGmψCAGAC<br>GGGAmψGmψGGAGAAGmψGGGGCCCCmψmψCGAmψCmψGGmψGmψACGGCAGCA<br>CCCAACCCCmψGGGCAGCmψCmψmψGmψGACCGGmψGCCCmψGGCmψGGmψACA<br>mψGmψmψmψCAGmψmψCCACCGGAmψCCmψGCAGmψACGCCCmψGCCGAGACAG<br>GAGmψCCCAGCGGCCAmψmψCmψmψmψmψGGAmψmψmψmψCAmψGGACAACmψm<br>ψGCmψGCmψGACCGAGGAmψGACCAGGAAACmψACCACmψCGGmψmψCCmψGCA<br>GACCGAAGCCGmψGACCCmψGCAGGACGmψGAGAGGCCGGGACmψACCAGAACG<br>CCAmψGCGGGmψGmψGGmψCCAACAmψCCCmψGGACmψGAAAAGCAAGCACGCA<br>CCmψCmψGACCCCmψAAAGAAGAGGAGmψACCmψGCAGGCCCAGGmψGCGGAGC<br>AGAAGCAAGCmψGGACGCCCCmψAAGGmψGGAmψCmψGCmψGGmψGAAGAAmψm<br>ψGCCmψCCmψGCCCCmψGAGAGAGmψACmψmψCAAGmψAmψmψmψCAGCCAGAA<br>mψAGmψCmψGCCCCmψGGGAGGCAGCGGCGGCGGCAmψGAACAACmψCCCAGGG<br>CAGAGmψGACCmψmψCGAGGACGmψGACCGmψGAAmψmψmψmψACACAGGGAGA<br>GmψGGCAGAGACmψGAACCCCGAGCAGAGAAACCmψGmψACCGGGAmψGmψGAm<br>ψGCmψGGAAAACmψACAGCAAmψCmψGGmψGmψCCGmψGGGCCAGGGCGAGACC<br>ACAAAGCCmψGACGmψGAmψCCmψGCGmψCmψGGAGCAGGGCAAGGAACCCmψG<br>GCmψGGAGGAGGAGGAGGmψGCmψGGGAAGCGGACGGGCCGAGAAGAACGGCGA<br>CAmψCGGCGGACAGAmψCmψGGAAGCCmψAAGGACGmψGAAAGAAAGCCmψGGG<br>CGGCCCAAGCAGCGGCGCCCCmψCCmψCCCAGCGGCGGCAGCCCAGCCGGCmψC<br>CCCAACCmψCmψACCGAGGAGGGCACCmψCmψGAGmψCCGCCACCCCCGAGAGC<br>GGCCCmψGGCACCmψCCACCGAGCCCAGCGAGGGCAGCGCACCCGGCAGCCCmψ<br>GCCGGCAGCCCCACCmψCCACAGAGGAGGGAACCAGCACCGAGCCCAGCGAAGG<br>CAGCGCCCCAGGCACCAGCACCGAGCCmψAGmψGAGCAGGAGAmψmψAAACGGA<br>mψCAACAAGAmψCAGAAGAAGACmψmψGmψGAAAGACAGCAACACCAAGAAGGC<br>CGGCAAGACAGGCCCCAmψGAAAACCCmψGCmψGGmψmψAGAGmψGAmψGACAC<br>CCGAmψCmψGAGAGAGCGGCmψGGAAAACCmψGAGAAAGAAGCCmψGAAAAmψA<br>mψCCCCCAGCCCAmψCAGCAAmψACAmψCmψAGAGCCAACCmψGAAmψAAGCmψ<br>GCmψGACCGAmψmψACACCGAAAmψGAAGAAGGCGAmψCCmψGCAmψGmψGmψA<br>CmψGGGAAGAGmψmψCCAGAAGGACCCmψGmψGGGCCmψGAmψGAGCCGGGmψG<br>GCCCAGCCmψGCCAGCAAGAAGAmψCGAmψCAGAACAAGCmψGAAACCmψGAGA<br>mψGGACGAGAAGGGCAACCmψGACCACCGCCGGCmψmψmψGCCmψGCmψCmψCA<br>GmψGmψGGCCAGCCCCmψGmψmψCGmψGmψACAAGCmψGGAGCAGGmψGmψCmψ<br>GAGAAGGGCAAGGCmψmψACACCAACmψACmψmψCGGACGGmψGCAAmψGmψGG<br>CCGAGCACGAAAAGCmψGAmψCCmψGCmψGGCCCAGCmψGAAGCCCGAGAAGGA<br>mψAGCGACGAAGCCGmψGACAmψAmψAGCCmψGGGAAAGmψmψmψGGGCAGAGG<br>GCCCmψGGAmψmψmψCmψACAGCAmψmψCAmψGmψGACCAAGGAGmψCCACCCA<br>CCCCGmψGAAGCCCCmψGGCCCAGAmψCGCCGGAAACAGAmψACGCCmψCCGGA<br>CCmψGmψGGGAAAGGCCCmψGAGCGACGCAmψGmψAmψGGGCACAAmψCGCCmψ<br>CCmψmψCCmψGmψCmψAAGmψACCAGGACAmψCAmψCAmψCGAACACCAGAAGG<br>mψGGmψGAAGGGCAACCAGAAGAGACmψGGAGAGCCmψGCGGGAGCmψGGCCGG<br>CAAGGAAAACCmψGGAmψACCCmψAGCGmψGACCCmψGCCCACCmψCAGCCmψC<br>ACACCAAGGAGGGCGmψmψGAmψGCCmψACAACGAAGmψGAmψCGCCCGGGmψG |

TABLE 19-continued

Full-length RNA sequences of LTRP5-ZIM3 and LTRP5-ADD-ZIM3 mRNA molecules assessed in this example.
Modification 'mψ' = N1-methyl-pseudouridine.

| LTRP molecule | SEQ ID NO | RNA Sequence |
|---|---|---|
| | | CGAAmψGmψGGGmψGAACCmψGAACCmψGmψGGCAGAAGCmψGAAGCmψAAGCA<br>GAGAmψGAmψGCCAAGCCmψCmψGCmψGAGACmψGAAGGGAmψmψCCCmψmψCC<br>mψmψmψCCmψCmψGGmψCGAGAGACAGGCCAACGAAGmψGGACmψGGmψGGGAC<br>AmψGGmψGmψGmψAACGmψGAAGAAGCmψGAmψCAACGAGAAAAAGGAGGAmψG<br>GCAAGGmψGmψmψmψmψGGCAGAAmψCmψGGCmψGGCmψACAAGAGACAGGAAG<br>CCCmψGAGACCAmψACCmψGAGCAGCGAGGAAGAmψCGGAAGAAGGGAAAGAAA<br>mψmψCGCmψCGGmψACCAGCmψGGGCGACCmψGCmψGCmψGCACCmψGGAAAAG<br>AAGCACGGCGAGGACmψGGGGAAAGGmψGmψACGACGAGGCCmψGGGAGCGGAm<br>ψmψGACAAGAAAGmψGGAAGGCCmψGAGCAAGCACAmψCAAGCmψGGAAGAGGA<br>ACGGAGAAGCGAGGACGCCCAGAGCAAGGCCGCCCmψGACCGACmψGGCmψGCG<br>GGCmψAAGGCCAGCmψmψCGmψGAmψCGAGGGCCmψGAAGGAGGCCGACAAGGA<br>CGAGGmψmψCmψGCAGAmψGCGAGCmψGAAGCmψGCAGAAGmψGGmψACGGGGAC<br>CmψGCGGGGAAAGCCCmψmψCGCCAmψCGAAGCCGAGAACAGCAmψCCmψGGAC<br>AmψCAGCGGCmψmψCAGCAAGCAGmψACAACmψGmψGCCmψmψCAmψCmψGGCA<br>GAAGGACGGCGmψGAAGAAGCmψGAACCmψGmψACCmψGAmψCAmψCAACmψAC<br>mψmψCAAGGGCGGCAAGCmψGCGGmψmψCAAGAAGAmψCAAACCmψGAGGCCmψ<br>mψCGAAGCCAACAGAmψmψCmψACACCGmψGAmψCAACAAAAAGAGCGGCGAGA<br>mψCGmψGCCCAmψGGAGGmψGAACmψmψCAACmψmψCGACGACCCCAACCmψGA<br>mψCAmψCCmψGCCmψCmψGGCCmψmψmψGGCAAGAGACAGGGCAGAGAAmψmψC<br>AmψCmψGGAACGACCmψGCmψGmψCCCmψGGAAACCGGCAGCCmψGAAGCmψGG<br>CCAACGGAAGAGmψGAmψCGAGAAGACACmψGmψACAACAGAAGAACCCGGCAG<br>GAmψGAGCCmψGCCCmψGmψmψCGmψGGCCCmψGACCmψmψCGAGCGGCGGGAG<br>GmψCCmψGGACmψCCmψCCAAmψAmψCAAACCAAmψGAACCmψGAmψCGGCGmψ<br>GGCAAGAGGCGAAAACAmψCCCCGCCGmψGAmψCGCCCmψGACCGACCCCGAGG<br>GCmψGCCCACmψGAGCCGGmψmψmψAAGGAmψAGCCmψGGGAAACCCAACCCAC<br>AmψCCmψGAGAAmψCGGCGAGAGCmψAmψAAGGAGAAGCAGCGGACCAmψCCAG<br>GCCAAGAAGGAGGmψGGAGCAGCGGAGAGCCGGCGGCmψACAGCCGGAAGmψAC<br>GCCAGCAAAGCCAAGAAmψCmψGGCAGACGAmψAmψGGmψGAGAAACACCGCmψ<br>AGAGAmψCmψGCmψGmψACmψACGCCGmψGACCCAGGAmψGCCAmψGCmψGAmψ<br>CmψmψCGCCAACCmψGAGCCGGGGCmψmψCGGCCGGCAGGGCAAGCGGACCmψm<br>ψCAmψGGCCGAGAGACAGmψACACACGGAmψGGAGGACmψGGCmψGACCGCCAA<br>GCmψGGCCmψACGAGGGCCmψGAGCAAGACCmψACCmψGmψCCAAGACACmψGG<br>CCAGCGCCGACmψACGACAGGGmψGCmψGGAGAAGCmψGAAGAAGACAGCAACA<br>GGCmψGGAmψGACCACAAmψmψAACGGCAAGGAGCmψGAAGGmψGGAGGGCCAG<br>AmψmψACCmψACmψACAACAGAmψACAAGAGACAGAACGmψAGmψCAAGGACCm<br>ψGmψCCGmψCGAGCmψGGAmψAGACmψGAGCGAAGAAmψCmψGmψGAACAACGA<br>CAmψCmψCCmψCCmψGGACAAAGGGCAGAAGCGGAGAAGCmψCmψGAGCCmψCC<br>mψGAAGAAAAGAmψCmψCCCAmψAGACCCGmψGCAGGAGAAGmψmψCGmψGmψm<br>ψGCCmψGAACmψGCGGCmψmψCGAGACACACGCAGCCGAGCAAGCCGCCCmψGA<br>ACAmψCGCCAGAmψCCmψGGCmψGmψmψCCmψGCGGAGCCAGGAGmψACAAGAA<br>AmψACCAGACAAACAAGACAACCGGCAACACCGAmψAAGAGAGCCmψmψCGmψC<br>GAGACCmψGGCAGmψCCmψmψmψmψACCGGAAGAAGCmψmψAAGGAGGmψGmψG<br>GAAACCmψGCCGmψGCGGmψCmψGGCGGAmψCmψGGCGGAGGCmψCCACCAGCC<br>CCAAGAAAAAGAGAAAAGmψCmψAAmψAGAmψAAGCmψGCCmψmψCmψGCGGGG<br>CmψmψGCCmψmψCmψGGCCAmψGCCCmψmψCmψmψCmψCmψCCCmψmψGCACCm<br>ψGmψACCmψCmψmψGGmψCmψmψmψGAAmψAAAGCCmψGAGmψAGGAAGmψCmψ<br>AGAAAAAAAAAAAAAAAAAAAAAAAAAAAAAAAAAAAAAAAAAAAAAAAAAAAA<br>AAAAAAAAAAAAAAAAAAAAAAAAAAAA |

TABLE 20

Full-length protein sequences of LTRP5-ZIM3 and LTRP5-ADD-ZIM3 mRNA molecules assessed in this example

| LTRP molecule | Amino acid sequence SEQ ID NO |
|---|---|
| LTRP5-ZIM3 | 3131 |
| LTRP5-ADD-ZIM3 | 3132 |

Synthesis of gRNAs:

Two gRNAs targeting the mouse PCSK9 locus were designed using gRNA scaffold 316 and chemically synthesized. PCSK9-targeting spacers 27.88 and 27.94 (sequences listed in Table 14) were assessed in this example. As shown in Example 2, use of spacer 27.88 was less effective in achieving PCSK9 knockdown than use of spacer 27.94.

Transfection of mRNA and gRNA into Hepa1-6 cells and intracellular PCSK9 staining were performed as described in Example 2. Briefly, each well of seeded Hepa1-6 cells was transfected with 300 ng of mRNA encoding LTRP5-ZIM3 or LTRP5-ADD-ZIM3 and 150 ng of PCSK9-targeting gRNA with spacer 27.88 or 27.94. Intracellular levels of PCSK9 protein were measured at various timepoints, up to day 53 post-transfection using an intracellular staining protocol as described earlier in Example 2. A non-targeting gRNA was used as an experimental control.

Results

Figure 10A:
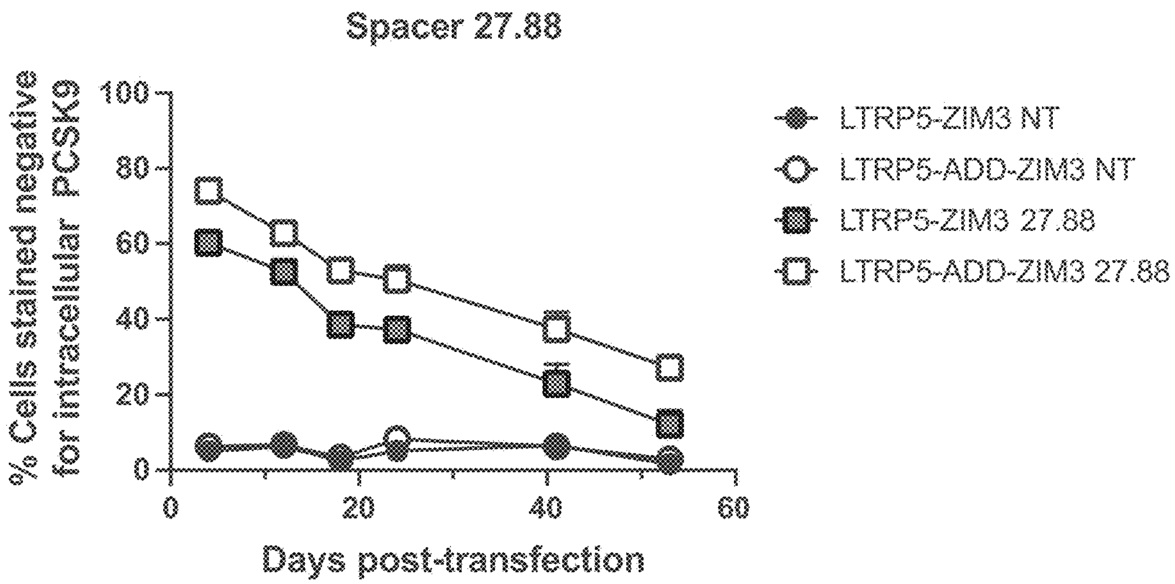
FIG. 10A is a time course plot showing the percentage of mouse Hepa1-6 cells, treated with LTRP5-ZIM3 or LTRP5-ADD-ZIM3 mRNA paired with the PCSK9-targeting gRNA with spacer 27.88, that stained negative for intracellular PCSK9 at 4, 12, 18, 24, 41, and 53 days post-delivery, as described in Example 4. A non-targeting (NT) spacer was used as an experimental control.
Figure 10B:
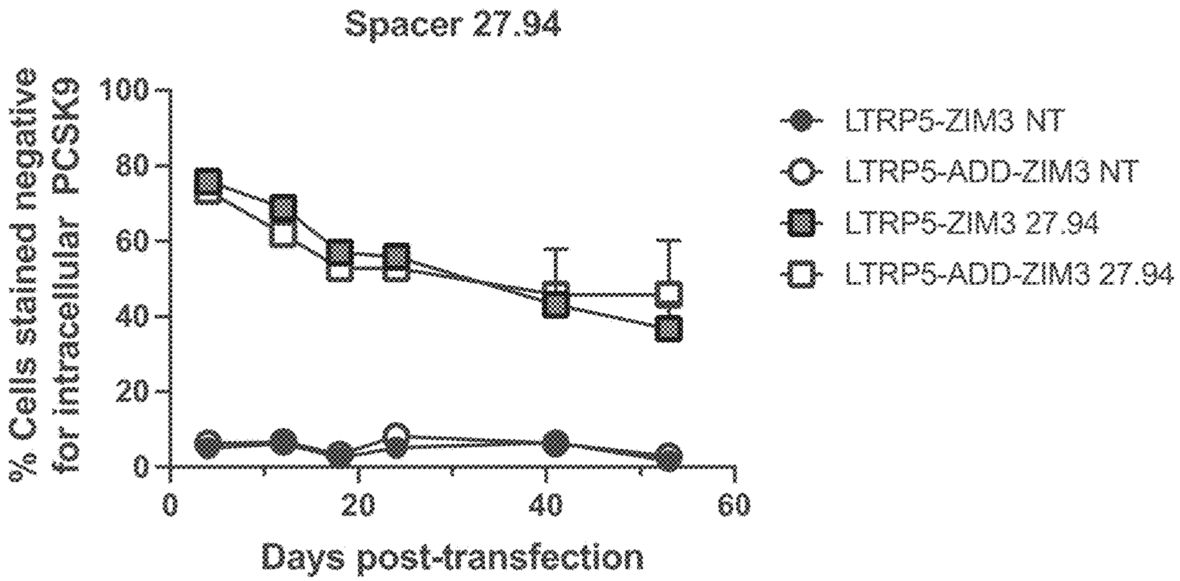
FIG. 10B is a time course plot showing the percentage of mouse Hepa1-6 cells, treated with LTRP5-ZIM3 or LTRP5-ADD-ZIM3 mRNA paired with the PCSK9-targeting gRNA with spacer 27.94, that stained negative for intracellular PCSK9 at 4, 12, 18, 24, 41, and 53 days post-delivery, as described in Example 4. A non-targeting (NT) spacer was used as an experimental control.

To determine the effects of incorporating the ADD domain into an LTRP molecule on activity, i.e., inducing more durable repression of an endogenous locus in vitro, mRNAs encoding LTRP5-ZIM3 or LTRP5-ADD-ZIM3 were co-transfected with a PCSK9-targeting gRNA into Hepa1-6 cells. The quantification of the resulting PCSK9 knockdown is shown in FIGS. 10A-10B. The data demonstrate a noticeable improvement in achieving PCSK9 knockdown when the cells were treated with LTRP5-ADD-ZIM3 than with LTRP5-ZIM3, and this improvement was more pronounced when using a PCSK9-targeting gRNA containing the weaker spacer 27.88. Further supporting the data discussed in Example 2, use of spacer 27.94 resulted in more durable repression than use of spacer 27.88 by day 53 when paired with either the LTRP5-ZIM3 or LTRP5-ADD-ZIM3 molecule (FIG. 10B). As expected, use of the non-targeting spacer did not result in PCSK9 knockdown.

These experiments demonstrate that use of LTRP constructs with the ADD domain can result in increased durable repression of an endogenous locus in cells compared to constructs without the ADD domain. Furthermore, these findings show that LTRP molecules with the ADD domain can be delivered as mRNA and co-transfected with a targeting gRNA to cells to induce effective silencing.

Example 5: Demonstration that mRNA Encoding for LTRPs Containing the ADD Domain can Induce Repression of an Endogenous Locus in Multiple Human Cell Lines Experiments were performed to demonstrate that mRNA encoding for LTRPs containing the ADD domain can induce long-term repression of an endogenous target locus in various human cell lines, when delivered as mRNA co-transfected with a targeting gRNA.

Materials and Methods

Generation of mRNA:

mRNA encoding the following molecules were generated by IVT following similar methods as described in Example 2:1) a catalytically-active CasX 676, 2) dXR1 (as described in Example 2), and 3) LTRP5-ADD-ZIM3 (as described in Example 4). Sequences encoding these molecules were codon-optimized using a codon utilization table, in addition to using a publicly available codon optimization tool and adjusting parameters such as GC content. The DNA and mRNA sequences encoding the catalytically-active CasX 676 are shown in Table 21 and Table 22 respectively. The DNA and mRNA sequences encoding for dXR1 are shown in Table 11 and Table 12 respectively. The DNA and mRNA sequences encoding for LTRP5-ADD-ZIM3 are shown in Table 18 and Table 19 respectively.

TABLE 21

Encoding sequences of the catalytically-active CasX 676 mRNA molecule assessed in this example*.

| CasX mRNA ID | Component (ID) | Description | DNA sequence or SEQ ID NO: |
|---|---|---|---|
| CasX 676 mRNA | 5'UTR | TriLink | 3047 |
| | START codon + c-MYC NLS | | 3133 |
| | CasX 676 | | 3134 |
| | c-MYC NLS + STOP codons | | 3135 |
| | 3'UTR | Mouse HBA | 3055 |
| | XbaI restriction site (partial) | | TCTAG |
| | Poly(A) tail | | 3057 |

*Components are listed in a 5' to 3' order within the constructs

TABLE 22

Full-length RNA sequences of catalytically-active CasX 676 mRNA molecule assessed in this example. Modification 'mψ' = N1-methyl-pseudouridine.

| CasX mRNA | SEQ ID NO | RNA Sequence |
|---|---|---|
| CasX 676 mRNA | 3136 | AAAmψAAGAGAGAAAAGAAGAGmψAAGAAG<br>AAAmψAmψAAGAGCCACCAmψGGCCCCmψG<br>CmψGCCAAGAGAGmψGAAGCmψGGAmψAGC<br>AGACAGGAGAmψCAAGCGGAmψmψAAmψAA<br>AAmψmψCGGAGAAGACmψGGmψGAAGGAmψ<br>mψCmψAACACAAAGAAGGCmψGGCAAGACA<br>CGGGGCCCmψAmψGAAGACACmψGCmψGGm<br>ψGAGAGmψGAmψGACACCCGACCmψGAGAG<br>AAAGACmψGGAAAACCmψGAGAAAGAAGCC<br>mψGAGAAmψAmψCCCCCAGCCCAmψCAGCA<br>ACACAAGCCGGGCCAACCmψGAAmψAAGCm<br>ψGCmψGACCGACmψACACCGAAAmψGAAGA<br>AGGCCAmψCCmψGCACGmψGmψAmψmψGGG<br>AAGAGmψmψCCAGAAAGACCCAGmψCGGCC<br>mψGAmψGAGCAGAGmψGGCmψCAGCCmψGC<br>CAGCAAGAAGAmψCGAmψCAGAACAAGCmψ<br>GAAGCCCGAAAmψGGACGAGAAGGGGAACC<br>mψAAACmψGGAACAGGmψGAGCGAAAAGGG<br>CAAGGCmψmψACACGAAmψmψACmψmψCGG<br>CAGAmψGCAACGmψGGCCGAGCACGAGAAG<br>CmψGAmψCAAGCmψGGCCCAGCmψGAAGCC<br>mψGAGAAGGAmψAGCGAmψGAGGCAGmψGA<br>CAmψAmψmψCCCmψGGGCAAGmψmψCGGAC<br>AGCGGGCCCmψGGAmψmψGCCCAAAmψmψG<br>CCGGCAACAGAmψACGCCmψCCAGCCCCGm<br>ψGGGCAAGGCCCmψGAGCmψCAmψCGAGCA<br>CCAGAAGGmψGGmψGAAGGGCAACCAGAAG<br>AGACmψGGAGAGCCmψGCGCGAGCmψGGCC<br>GGCAAGGAAAACCmψGGAGmψAmψCCmψAG<br>CAmψGACCCmψGCCmψCCmψCAGCCmψCAm<br>ψACAAAGGAGGGCGmψGGAmψGCCmψACAA<br>CGAAGmψGAmψCGCCCGGGmψGCGGAmψGm<br>ψGGGmψGAACCmψGAAmψCmψGmψGGCAGA<br>AGCmψGAAGCmψGmψCmψAGAGACGACGCC<br>AAGCCCCmψGCmψGAGACmψGAAGGGCmψm<br>ψCCCCAGCmψmψCCCmψCmψGGmψGGAGAG<br>ACAGGCAAAmψGAAGmψGGACmψGGmψGGG<br>ACAmψGGmψGmψGmψAACGmψGAAGAAGCm<br>ψGAmψCAAmψGAGAAGAAGGAGGACGGCAA<br>AGmψGmψmψCmψGGCAGAAmψCmψGGCCGG<br>CmψACAAGCGmψCAGGAGGCCCmψGCGGCC<br>CmψACCmψGAGCAGCGAGGAAGACAGAAAG<br>AAGGGCAAGAAGmψmψCGCCCGGmψAmψCA<br>GCmψGGGGGACCmψGCmψGCmψGCACCmψC<br>GAGAAGAAGCACGGCGAAGACmψGGGGGAA<br>GGmψGmψACGAmψGAGGCCmψGGGAGCGGA |

TABLE 22-continued

Full-length RNA sequences of catalytically-active CasX 676 mRNA molecule assessed in this example.
Modification 'mψ' = N1-methyl-pseudouridine.

| CasX mRNA | SEQ ID NO | RNA Sequence |
|---|---|---|
| | | mψCGAmψAAGAAGGmψGGAGGGCCmψGAGC<br>AAGCACAmψCAAGCmψGGAGGAGGAACGGA<br>GAmψCmψGAGGACGCCCAGAGCAAGGCCGC<br>CCmψGACCGACmψGGCmψGAGAGCCAAGGC<br>CAGCmψmψCGmψCAmψCGAGGGGCmψGAAG<br>GAGGCCGACAAGGACGAGmψmψCmψGCCGG<br>mψGCGAACmψGAAGCmψGCAGAAGmψGGmψ<br>ACGGAGAmψCmψGAGAGGCAAACCmψmψmψ<br>CGCCAmψCGAGGCCGAGAACAGCAmψCCmψ<br>GGACAmψCAGCGGCmψmψCAGCAAGCAGmψ<br>ACAACmψGCGCCmψmψmψAmψmψmψGGCAG<br>AAGGACGGAGmψGAAGAAGCmψGAACCmψG<br>mψACCmψGAmψCAmψCAACmψAmψmψmψCA<br>AGGGCGGCAAGCmψGAGAmψmψCAAGAAAA<br>GCGGAGAGAmψCGmψGCCAAmψGGAAGmψG<br>AACmψmψCAACmψmψCGACGACCCmψAACC<br>mψGAmψCAmψCCmψGCCCCmψGGCAmψmψm<br>ψGGCAAGCGGCAGGGCAGAGAGmψmψCAmψ<br>CmψGGAACGACCmψGCmψGmψCmψCmψGGA<br>GACCGGCAGCCmψGAAGCmψGGCCAACGGC<br>AGAGmψGAmψCGAGAAGACACmψGmψACAA<br>CAGACGAACCAGACAAGACGAGCCCGCCCm<br>ψGmψmψmψGmψGGCCCmψGACCmψmψCGAG<br>AGAAGAGAGGmψGCmψGGACAGCAGCAAmψ<br>AmψCAAGCCmψAmψGAACCmψGAmψCGGCG<br>mψGGACCGGGGCGAGAACAmψCCCmψGCCG<br>mψGAmψCGCCCmψmψACCGACCCCGAGGGA<br>mψGCCCmψCmψGAGCCGGmψmψmψAAAGAC<br>AGCCmψGGGCAACCCmψACCCACAmψCCmψ<br>GAGAAmψmψGGCGAGmψCCmψACAAGGAGA<br>AGCAGAGAACCAmψCCAGGCCAAGAAGGAG<br>GmψGGAGCAGCGGCGGGCmψGGCGGCmψAC<br>mψCCCGGAAGmψACGCCAGCAAGGCCAAGA<br>ACCmψGGCCGACGACAmψGGmψmψAGAAAm<br>ψACCGCCAGAGACCmψCCmψGmψACmψACG<br>CmψGmψGACCCAGGACGCCAmψGCmψGAmψ<br>CmψmψCGAGAACCmψGAGCAGAGGCmψmψC<br>GGCAGACAGGGCAAGAGAACCmψmψCAmψG<br>GCCGAGAGACAGmψACACCCGGAmψGGAGG<br>ACmψGGCmψGACCGCCAAGCmψGGCCmψAC<br>GAGGGCCmψGCCCmψCmψAAGACCmψACCm<br>ψGmψCCAAGACCmψmψGGCACAGmψACACC<br>AGCAAGACAmψGCmψCmψAACmψGCGGCmψ<br>mψCACAAmψCACGAGCGCCGACmψACGACC<br>GGGmψGCmψGGAGAAACmψGAAGAAGACCG<br>CCACAGGCmψGGAmψGACCACCAmψmψAAC<br>GGCAAGGAGCmψGAAGGmψGGAGGGCCAGA<br>mψCACCmψACmψACAACAGGmψACAAACGG<br>CAGAACGmψGGmψGAAGGACCmψGAGCGmψ<br>GGAACmψGGAmψAGACmψGAGCGAGGAAAG<br>CGmψAAACAAmψGACAmψCAGCAGCmψGGA<br>CCAAGGGCCGGAGCGGCGAGGCCCmψGAGC<br>CmψGCmψGAAGAAGAGAmψmψCmψCCCACA<br>GACCAGmψGCAGGAGAAGmψmψCGmψGmψG<br>mψCmψGAACmψGCGGCmψmψCGAGACCCAC<br>GCCGACGAGCAAGCCGCCCmψGAACAmψCG<br>CCCGGmψCmψmψGGCmψmψmψmψCCmψGCG<br>GAGCCAGGAGmψACAAGAAGmψACCAGACA<br>AACAAGACCACAGGCAACACAGACAAGAGA<br>GCCmψmψCGmψCGAGACCmψGGCAGAGCmψ<br>mψCmψACAGAAAGAAGCmψGAAGGAGGmψG<br>mψGGAAGCCmψGCCGmψGGGAAGCCCCGCm<br>ψGCCAAGAGAGmψGAAGCmψGGACmψAAmψ<br>AGAmψAAGCmψGCCmψmψCmψGCGGGGCmψ<br>mψGCCmψmψCmψGGCCAmψGCCCmψmψCmψ<br>mψCmψCmψCCCmψmψGCACCmψGmψACCmψ<br>CmψmψGGmψCmψmψmψGAAmψAAAGCCmψG<br>AGmψAGGAAGmψCmψAGAAAAAAAAAAAAA<br>AAAAAAAAAAAAAAAAAAAAAAAAAAAAAA<br>AAAAAAAAAAAAAAAAAAAAAAAAAAAAAA<br>AAAAAAA |

Synthesis of gRNAs:

gRNAs targeting the human PCSK9 locus were designed using gRNA scaffold 316 and chemically synthesized. Furthermore, a B2M-targeting gRNA was used as an experimental control. Sequences of targeting spacers as assessed in this example as listed in Table 23.

TABLE 23

Sequences of spacers assessed in this example.

| Spacer ID | Target | Targeting spacer sequence (RNA) | SEQ ID NO |
|---|---|---|---|
| 7.37 | human B2M | GGCCGAGAUGUCUCGCUCCG | 3137 |
| 6.1 | human PCSK9 | GAGGAGGACGGCCUGGCCGA | 1834 |
| 6.125 | human PCSK9 | AGAAAGAGCAAGCCUCAUGU | 1845 |
| 6.138 | human PCSK9 | AGGGAUUUAUACUACAAAGA | 1852 |
| 6.153 | human PCSK9 | GUUAAUGUUUAAUCAGAUAG | 1866 |
| 6.157 | human PCSK9 | GGGUCUGAGCCUGGAGGAGU | 1869 |
| 6.172 | human PCSK9 | GCUGAAACAGAUGGAAUACU | 1879 |
| 6.181 | human PCSK9 | UCAUCUGCACUCGUGGCCAC | 2228 |

Transfection of mRNA and gRNA into HepG2 Cells, Hep3B Cells, and Huh7 Cells and ELISA to Assess PCSK9 Secretion:

The following three human hepatocyte cancer cell lines were used in this experiment: HepG2 cells, Hep3B cells, and Huh7 cells. ~15,000 cells of each cell line were seeded per well; the next day, seeded cells were transfected with mRNA encoding a catalytically-active CasX 676, dXR1, or LTRP5-ADD-ZIM3 and a gRNA with scaffold 316 and spacer targeting either the B2M or PCSK9 locus (see Table 23 for specific spacers and sequences). Media supernatant was harvested at 4 days post-transfection to assess level of PCSK9 secretion by ELISA, and levels of PCSK9 secretion were normalized to total cell count and illustrated in FIGS. 11A-11C. Culturing of treated Huh7 cells continued, and media supernatant was harvested at 14 and 27 days post-transfection for measuring PCSK9 secretion by ELISA. As an additional experimental control, PCSK9 secretion was also measured in the media supernatant harvested from wells containing untreated, naïve cells.

Results

Figure 11A:
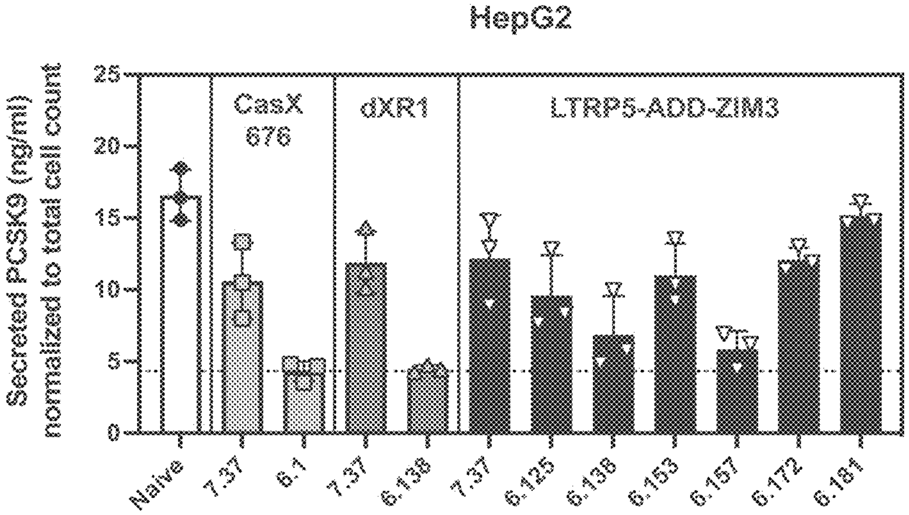
FIG. 11A is a bar plot showing the quantification of normalized secreted PCSK9 levels at 4 days post-transfection in HepG2 cells lipofected with mRNA encoding for CasX 676, dXR1, or LTRP5-ADD-ZIM3 when paired with the indicated targeting gRNAs, as described in Example 5. Secreted PCSK9 levels were normalized to total cell count. Naïve, untreated cells served as experimental controls.
Figure 11B:
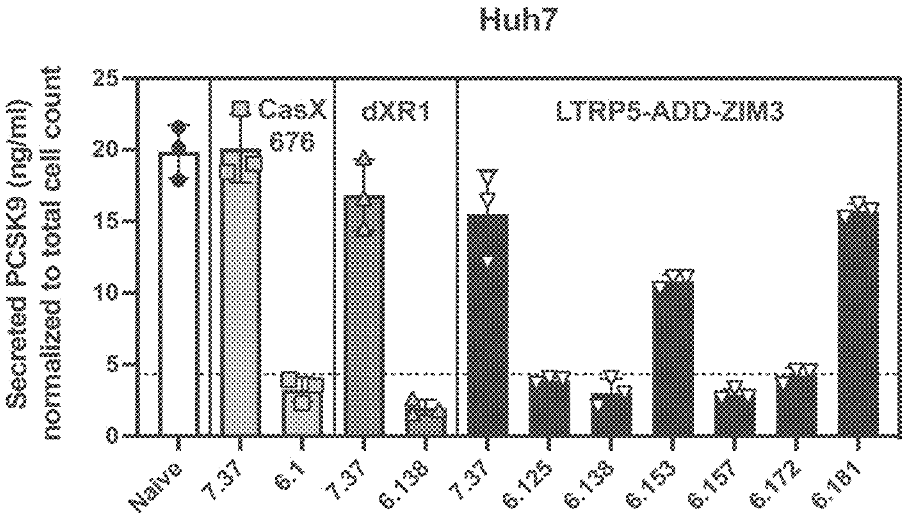
FIG. 11B is a bar plot showing the quantification of normalized secreted PCSK9 levels at 4 days post-transfection in Huh7 cells lipofected with mRNA encoding for CasX 676, dXR1, or LTRP5-ADD-ZIM3 when paired with the indicated targeting gRNAs, as described in Example 5. Secreted PCSK9 levels were normalized to total cell count. Naïve, untreated cells served as experimental controls.
Figure 11C:
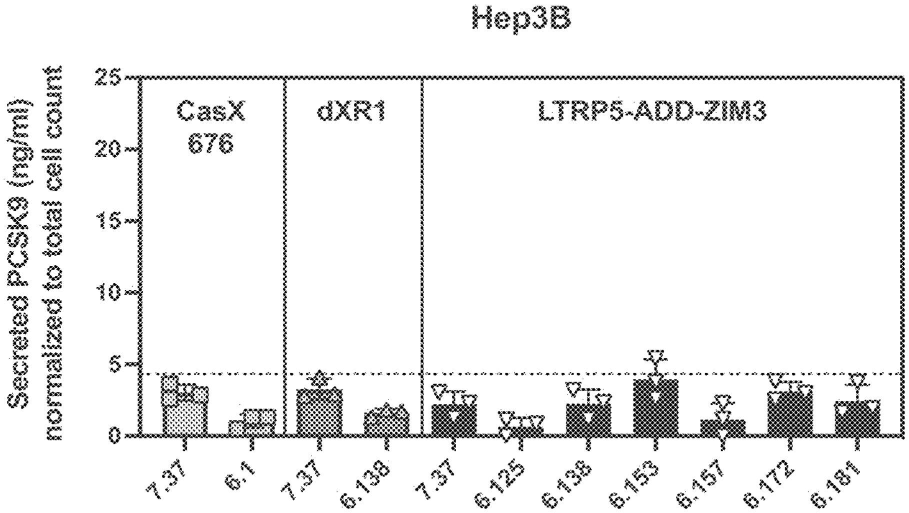
FIG. 11C is a bar plot showing the quantification of normalized secreted PCSK9 levels at 4 days post-transfection in Hep3B cells lipofected with mRNA encoding for CasX 676, dXR1, or LTRP5-ADD-ZIM3 when paired with the indicated targeting gRNAs, as described in Example 5. Secreted PCSK9 levels were normalized to total cell count. Naïve, untreated cells served as experimental controls.

HepG2 cells, Hep3B cells, and Huh7 cells were transfected with mRNA encoding catalytically-active CasX 676, dXR1, or LTRP5-ADD-ZIM3 with a gRNA targeting either the B2M or the PCSK9 locus, and secreted PCSK9 levels were measured. Quantification of normalized PCSK9 secretion levels for each condition at 4 days post-transfection is depicted in FIGS. 11A-11C. The data demonstrate that the most efficient knockdown of PCSK9 secretion by CasX 676, dXR1, or LTRP5-ADD-ZIM3 was observed in Huh7 cells, while HepG2 cells did not exhibit as efficient of a knockdown of secreted PCSK9 levels (FIG. 11A-11C). Meanwhile, Hep3B cells demonstrated low PCSK9 secretion levels overall, illustrating that, of the cell lines used, the Hep3B cell line is the least amenable to treatment to induce and demonstrate PCSK9 repression (FIG. 11A-11C).

Figure 12:
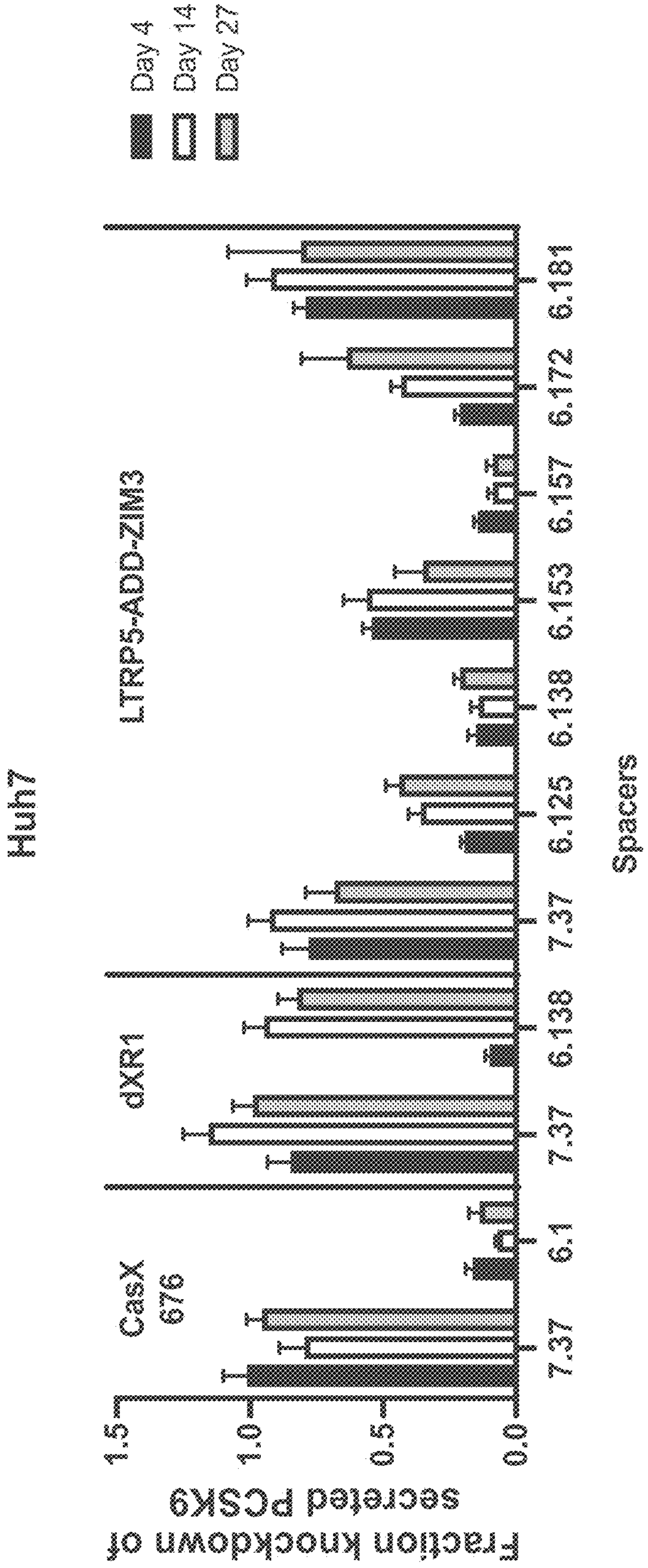
FIG. 12 is a bar plot showing the quantification of secreted PCSK9 levels at 4, 14, and 27 days post-transfection in Huh7 cells lipofected with mRNA encoding for CasX 676, dXR1, or LTRP5-ADD-ZIM3 when paired with the indicated targeting gRNAs, as described in Example 5. Quantification of secreted PCSK9 levels is shown as relative to the secreted levels detected in the naïve, untreated cells at the day 4 timepoint.

Culturing of treated Huh7 cells continued up to day 27 post-transfection, and PCSK9 secretion was measured at day 14 and day 27. The bar plot in FIG. 12 shows the quantification results of PCSK9 repression at day 4, day 14, and day 27 timepoints displayed as PCSK9 knockdown relative to the levels detected for the naïve control at the day 4 timepoint. The data demonstrate that treatment of Huh7 cells with LTRP5-ADD-ZIM3 with gRNAs having spacers 6.138 and 6.157 resulted in the most effective repression of PCSK9 secretion, and this repression was sustained through day 27 post-transfection (FIG. 12). Similarly, sustained knockdown was observed when Huh7 cells were treated with catalytically-active CasX 676 with spacer 6.1. While treatment with dXR1 and spacer 6.138 resulted in an initial strong repression at day 4, this repressive effect was transient as PCSK9 secretion levels returned to baseline levels at day 14 and day 27 post-transfection (FIG. 12). As anticipated, treatment with any of the three mRNA molecules with spacer 7.37 targeting the B2M locus did not affect PCSK9 secretion levels during this time course experiment.

These experiments demonstrate that use of LTRP molecules with the ADD domain with the appropriate targeting spacer can result in long-term silencing of an endogenous target locus in various human cell lines. These findings also show that LTRP molecules with the ADD domain can be co-delivered as mRNA with a targeting gRNA to cells to induce repression.

Example 6: Demonstration that Use of Certain PCSK9-Targeting Spacers can Result in Undesired Intracellular PCSK9 Retention Secretory proteins that cannot properly fold are consequently retained in the endoplasmic reticulum (ER) to be ultimately targeted for proteasomal degradation. However, excessive protein accumulation in the ER could cause ER stress. PCSK9 is initially synthesized as a zymogen (known as pro-PCSK9) that undergoes autocatalytic cleavage during maturation in the ER into an inactive secretory protein (also known as mature or processed PCSK9). Furthermore, certain gain-of-function mutations in the PCSK9 gene resulting in hypercholesterolemia have been shown to be associated with intracellular PCSK9 retention in the ER (Benjannet S et al. NARC-1/PCSK9 and its natural mutants: zymogen cleavage and effects on the low density lipoprotein (LDL) receptor and LDL cholesterol. *J. Biol. Chem.* 279:48865-48875 (2004); Park S W et al., Post-transcriptional regulation of low density lipoprotein receptor protein by proprotein convertase subtilisin/kexin type 9a in mouse liver. J. Biol. Chem. 279:50630-50638 (2004); Uribe K B et al. A Systematic Approach to Assess the Activity and Classification of PCSK9 Variants. Int. J. Mol. Sci. 22:13602(2021)), an indication that targeting certain regions of the PCSK9 locus may result in undesired intracellular retention. As a result, experiments were performed to demonstrate that use of certain PCSK9-targeting spacers can result in unwanted increase in intracellular PCSK9 levels that may possibly cause unexpected consequences such as abnormal ER stress.

Materials and Methods

In vitro transcription of CasX 676 mRNA #2 (sequence listed in Table 28, below) was performed as described in Example 7, below. Guide RNAs using scaffold 316 and a PCSK9-targeting spacer were synthesized with a v1 modification profile (as discussed in Example 7). Spacers 6.1, 6.8, 6.86, 6.114, 6.197, and 6.203 (sequences listed in Table 24) were assessed for intracellular PCSK9 retention.

TABLE 24

Sequences of human PCSK9-targeting spacers

| Spacer ID | Spacer DNA sequence | SEQ ID NO: | Spacer RNA sequence | SEQ ID NO: |
|---|---|---|---|---|
| 6.1 | GAGGAGGACG GCCTGGCCGA | 2977 | GAGGAGGACG GCCUGGCCGA | 1834 |
| 6.8 | TGGCTTCCTG GTGAAGATGA | 3139 | UGGCUUCCUG GUGAAGAUGA | 2009 |
| 6.86 | TGGTGAAGAT GAGTGGCGAC | 3464 | UGGUGAAGAU GAGUGGCGAC | 3466 |
| 6.114 | TCCCAGGCCT GGAGTTTATT | 3141 | UCCCAGGCCU GGAGUUUAUU | 2291 |
| 6.197 | AGGTCATCAC AGTTGGGGCC | 3465 | AGGUCAUCAC AGUUGGGGCC | 3467 |
| 6.203 | CCAGGAGTGG GAAGCGGCGG | 3144 | CCAGGAGUGG GAAGCGGCGG | 2341 |

In Vitro Delivery of CasX mRNA and gRNA Via Transfection:

To determine whether use of certain PCSK9-targeting spacers would result in potential intracellular PCSK9 retention, ~50,000 HepG2 cells were seeded per well in a 96-well plate. CasX 676 mRNA #2 was transfected into HepG2 cells with a PCSK9-targeting gRNA using Lipofectamine™. After a media change, the following were harvested two days post-transfection: 1) media supernatant to measure secreted PCSK9 protein levels by ELISA; and 2) transfected cells for western blotting analysis to evaluate intracellular PCSK9 levels. Harvested cells were subjected to whole cell lysate extraction for western blotting analysis. Briefly, extracted protein samples were resolved by SDS-PAGE followed by immunoblotting to analyze levels of pro-PCSK9 and processed PCSK9, which were quantified by densitometry. Secreted PCSK9 levels in the media supernatant were analyzed using the BioLegend® ELISA MAX™ kit following the manufacturer's instructions. Naïve, untreated cells and cells transfected with CasX 676 mRNA #2 only served as two experimental controls.

Results

Figure 13:
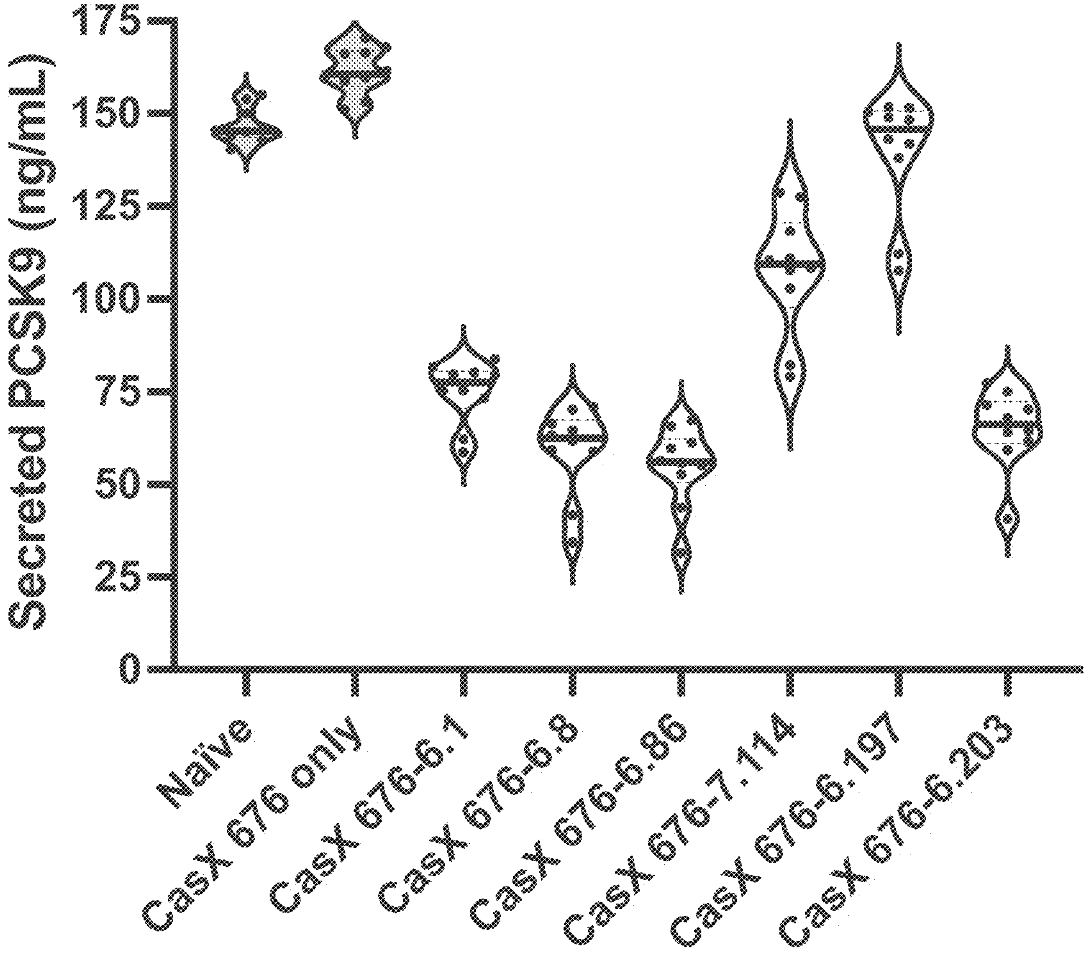
FIG. 13 is a violin plot showing the distribution of secreted PCSK9 levels in HepG2 cells transfected with CasX 676 mRNA #2 and a gRNA with the indicated PCSK9-targeting spacer, as described in Example 6. Naïve, untreated cells and cells transfected with CasX 676 mRNA only served as experimental controls.

Following transfection of HepG2 cells with CasX 676 mRNA #2 and a PCSK9-targeting gRNA, secreted PCSK9 levels in the media supernatant were quantified by ELISA, and the results are shown in FIG. 13. The data demonstrate that transfection of HepG2s cells with CasX 676 mRNA and the PCSK9-targeting gRNAs resulted in reduced secreted PCSK9 levels to varying degrees. Of the spacers tested, use of spacers 6.1, 6.8, 6.86, and 6.203 resulted in nearly 50% reduction in secreted levels compared to cells transfected with CasX 676 mRNA only (FIG. 13).

Figure 14:
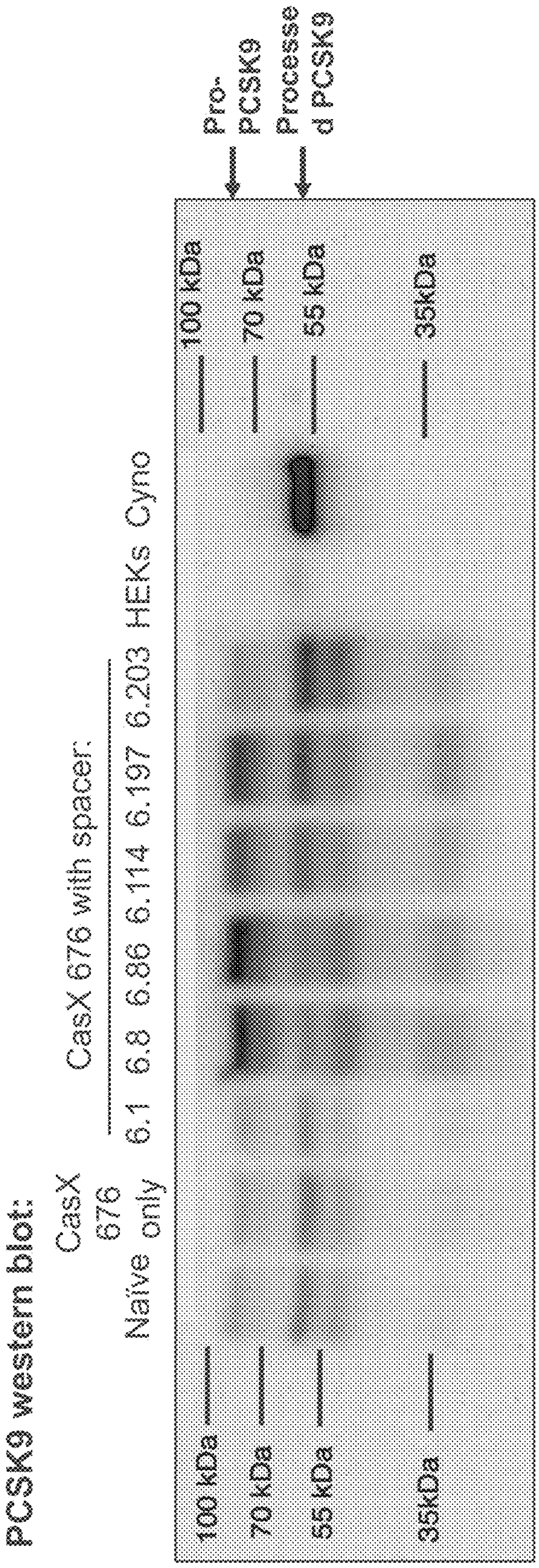
FIG. 14 is a pair of representative western blots showing the levels of pro-PCSK9 and processed PCSK9 protein (top western blot) in HepG2 cells transfected with CasX 676 mRNA and a gRNA with the indicated PCSK9-targeting spacer, as described in Example 6. Naïve, untreated cells and cells transfected with CasX 676 mRNA only served as experimental controls. Lysate from HEK293T cells, which do not express the PCSK9 protein, and a cynomolgus macaque recombinant PCSK9 protein control were used as western blot controls. The bottom western blot shows the total protein loading control.
Figure 14:
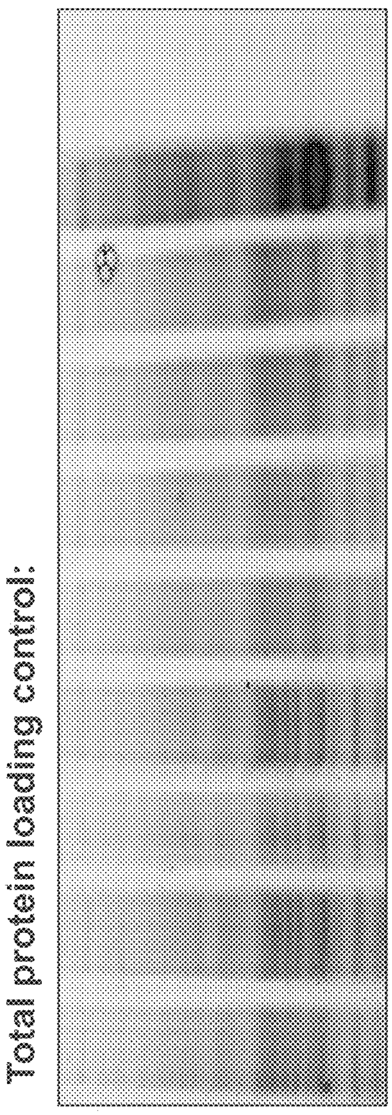
Figure 15:
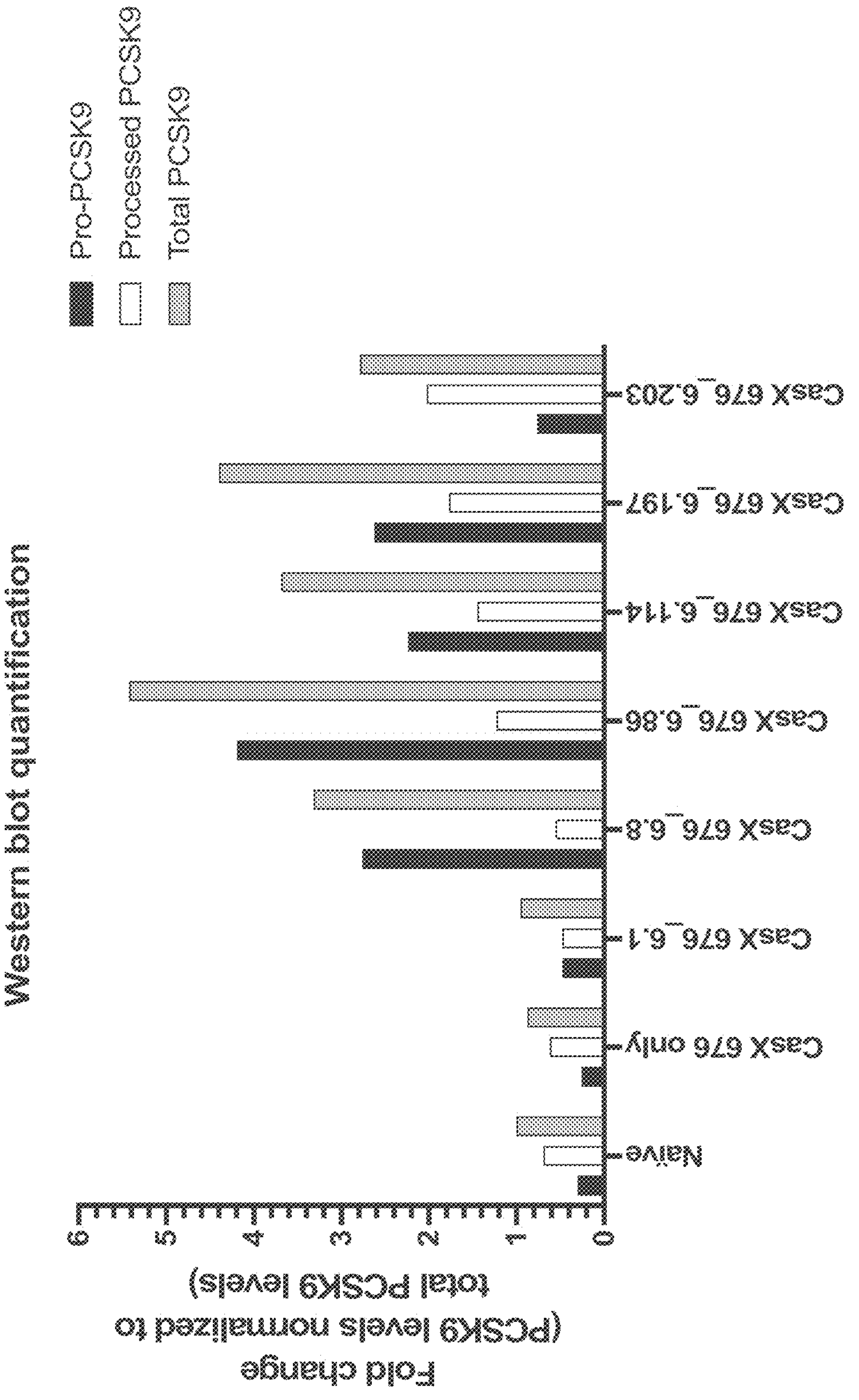
FIG. 15 is a bar plot showing the western blot quantification for pro-PCSK9, processed PCSK9, and total PCSK9 levels for each of the indicated spacers assessed when transfected with CasX 676 mRNA into HepG2 cells, as described in Example 6. Naïve, untreated cells and cells transfected with CasX 676 mRNA only served as experimental controls. PCSK9 levels were normalized to total PCSK9 levels from the naïve condition.

Intracellular levels of PCSK9 were also evaluated in the transfected HepG2 cells. FIG. 14 is a western blot analysis of PCSK9 protein levels, along with the total protein loading control, in the transfected HepG2 cells, and FIG. 15 is a bar plot illustrating the densitometry quantification for pro-PCSK9, processed PCSK9, and total PCSK9 protein levels normalized to total PCSK9 levels from the naïve condition. The data show that of the PCSK9-targeting spacers assessed, only use of spacer 6.1 did not result in substantially increased pro-PCSK9 levels, therefore indicating that use of spacer 6.1 did not increase intracellular protein levels (FIGS. 14-15). While use of spacer 6.203 also did not noticeably increase intracellular protein levels, its use resulted in increased processed PCSK9 levels (FIGS. 14-15), appearing to contradict findings of its effects to reduce secreted PCSK9 levels (FIG. 13) when compared to the either the naïve or CasX mRNA only control. This apparent contradictory effect observed by use of spacer 6.203 indicates that retention of processed PCSK9 may be involved in the mechanism by which use of spacer 6.203 decreases PCSK9 secretion.

The results demonstrate that although use of certain PCSK9-targeting spacers would result in decreased secreted PCSK9 levels, there is a possibility for some of these seemingly effective spacers to exhibit potentially undesired characteristics, such as increased intracellular protein retention. Therefore, the findings from these experiments indicate the use of assessing increased intracellular protein retention as a potential safety criterion to identify effective targeting spacers for therapeutic use.

Example 7: Design and Assessment of Modified gRNAs in Improving Editing when Delivered Together with CasX mRNA In Vitro and In Vivo Experiments were performed to identify new gRNA variant sequences and demonstrate that chemical modifications of these gRNA variants enhance the editing efficiency of the CasX:gRNA system when delivered in vitro in conjunction with CasX mRNA.

Materials and Methods

Synthesis of gRNAs:

All gRNAs tested in this example were chemically-synthesized and were derived from gRNA scaffolds 174, 235, and 316. The sequences of gRNA scaffolds 174, 235, and 316 and their chemical modification profiles are listed in Table 25. The sequences of the resulting gRNAs, including spacers targeting PCSK9, B2M, or ROSA26, and their chemical modification profiles assayed in this example are listed in Table 26. A schematic of the structure of gRNA scaffold variants 174, 235, and 316 are shown in FIGS. 19A-19C. respectively, and the sites of chemical modifications of the gRNA variants are shown schematically in FIGS. 16A, 16B, 18, 24, and 25.

TABLE 25

Sequences of gRNA scaffolds with their different chemical modification profiles (denoted by version number), where "NNNNNNNNNNNNNNNNNNNN" is a spacer placeholder. Chemical modifications: * = phosphorothioate bond; m = 2'OMe modification

| gRNA scaffold (version) | gRNA sequence | SEQ ID NO: |
|---|---|---|
| 174 (v0) | ACUGGCGCUUUUAUCUGAUU<br>ACUUUGAGAGCCAUCACCAG<br>CGACUAUGUCGUAGUGGGUA<br>AAGCUCCCUCUUCGGAGGGA<br>GCAUCAAAGNNNNNNNNNNN<br>NNNNNNNNN | 2947 |
| 174 (v1) | mA*mC*mU*GGCGCUUUUAU<br>CUGAUUACUUUGAGAGCCAU<br>CACCAGCGACUAUGUCGUAG | 2948 |

TABLE 25-continued

Sequences of gRNA scaffolds with their different chemical modification profiles (denoted by version number), where "NNNNNNNNNNNNNNNNNNNN" is a spacer placeholder. Chemical modifications: * = phosphorothioate bond; m = 2'OMe modification

| gRNA scaffold (version) | gRNA sequence | SEQ ID NO: |
|---|---|---|
| | UGGGUAAAGCUCCCUCUUCG<br>GAGGGAGCAUCAAAGNNNNN<br>NNNNNNNNNNNNmN*mN*mN | |
| 174 (v2) | mA*mC*mU*GGCGCUUUUAU<br>CUGAUUACUUUGAGAGCCAU<br>CACCAGCGACUAUGUCGUAG<br>UGGGUAAAGCUCCCUCUUCG<br>GAGGGAGCAUCAAAGNNNNN<br>NNNNNNNNNNNNNNN*mU*m<br>U*mU | 2949 |
| 174 (v3) | mA*mC*mU*mGmGmCmGmCm<br>UmUmUmUmAmUmCmUmGmAm<br>UUACUUUGmAmGmAmGmCmC<br>mAmUmCmAmCmCAGCGAmCm<br>UAUmGmUmCmGUAGUGmGmG<br>mUmAmAmAmGmCmUmCmCmC<br>mUmCmUmUmCmGmGmAmGmG<br>mGmAmGmCmAmUmCmAAAGN<br>NNNNNNNNNNNNNNNNmN*m<br>N*mN | 2950 |
| 174 (v4) | mA*mC*mU*mGmGmCmGmCU<br>UUUmAmUmCmUmGmAmUUAC<br>UUUGmAmGmAmGmCmCmAmU<br>mCmAmCmCAGCGAmCmUAUm<br>GmUmCmGUAGUGmGmGmUmA<br>mAmAmGmCmUmCmCmCmUmC<br>mUmUmCmGmGmAmGmGmGmA<br>mGmCmAmUCAAAGNNNNNNN<br>NNNNNNNNNNmN*mN*mN | 2951 |
| 174 (v5) | mA*mC*mU*GGCGCUUUUAU<br>CUGAUUACUUUGAGAGCCAU<br>CACCAGCGAmCmUAUmGmUm<br>CmGUAGUGGGUAAAmGmCmU<br>mCmCmCmUmCmUmUmCmGmG<br>mAmGmGmGmAmGmCAUCAAA<br>GNNNNNNNNNNNNNNNNNmN<br>*mN*mN | 2952 |
| 174 (v6) | mA*mC*mU*GGCGCUUUUAU<br>CUGAUUACUUUGAGAGCCAU<br>CACCAGCGACUAUGUCGUAG<br>UGGGUAAAmGmCmUmCmCmC<br>mUmCmUmUmCmGmGmAmGmG<br>mGmAmGmCAUCAAAGNNNNN<br>NNNNNNNNNNNNmN*mN*mN | 2953 |
| 174 (v7) | mA*mC*mU*GGmCGmCmUUU<br>UAmUmCUGAUUACUUUGmAm<br>GAGCCmAmUmCmAmCCAGCm<br>GmAmCmUAUmGmUmCmGUAG<br>UGGmGmUAmAmAmGmCmUmC<br>mCmCmUmCmUmUmCmGmGmA<br>mGmGmGmAmGmCmAmUCAAA<br>GNNNNNNNNNNNNNNNNN*m<br>N*mN*mN | 2954 |
| 174 (v8) | mA*mC*mU*GGCGCUUUUAU<br>CUGAUUACUUUGAGAGCCmA<br>mUmCmAmCCAGCmGmAmCmU<br>AUmGmUmCmGUAGUGGmGmU<br>mAmAAmGmCmUmCmCmCmUm | 2955 |

TABLE 25-continued

Sequences of gRNA scaffolds with their different chemical modification profiles (denoted by version number), where "NNNNNNNNNNNNNNNNNNNN" is a spacer placeholder. Chemical modifications: * = phosphorothioate bond; m = 2'OMe modification

| gRNA scaffold (version) | gRNA sequence | SEQ ID NO: |
|---|---|---|
| | CmUmUmCmGmGmAmGmGmGmAmGmCmAmUCAAAGNNNNNNNNNNNNNNNNN*mN*mN*mN | |
| 174 (v9) | mA*mC*mU*GGmCmGCmUUUUAmUmCUGAUUACUUUGmAmGAGCCAUCACCAGCmGmAmCmUAUmGmUmCmGUAGUGGGUAAAmGmCmUmCmCmCmUmCmUmUmCmGmGmAmGmGmGmAmGmCAUCAAAGNNNNNNNNNNNNNNNNN*mN*mN*mN | 2956 |
| 235 (v0) | ACUGGCGCUUCUAUCUGAUUACUCUGAGCGCCAUCACCAGCGACUAUGUCGUAGUGGGUAAAGCCGCUUACGGACUUCGGUCCGUAAGAGGCAUCAGAGNNNNNNNNNNNNNNNNNNNN | 2957 |
| 235 (v1) | mA*mC*mU*GGCGCUUCUAUCUGAUUACUCUGAGCGCCAUCACCAGCGACUAUGUCGUAGUGGGUAAAGCCGCUUACGGACUUCGGUCCGUAAGAGGCAUCAGAGNNNNNNNNNNNNNNNNNmN*mN*mN | 2958 |
| 235 (v2) | mA*mC*mU*GGCGCUUCUAUCUGAUUACUCUGAGCGCCAUCACCAGCGACUAUGUCGUAGUGGGUAAAGCCGCUUACGGACUUCGGUCCGUAAGAGGCAUCAGAGNNNNNNNNNNNNNNNNNNNN*mU*mU*mU | 2959 |
| 235 (v3) | mA*mC*mU*mGmGmCmGmCmUmUmCmUmAmUmCmUmGmAmUUACUCUGmAmGmCmGmCmCmAmUmCmAmCmCAGCGAmCmUAUmGmUmCmGUAGUGmGmGmUmAmAmAmGmCmCmGmCmUmUmAmCmGmGmAmCmUmUmCmGmGmUmCmCmGmUmAmAmGmAmGmGmCmAmUmCmAGAGNNNNNNNNNNNNNNNNNNmN*mN*mN | 2960 |
| 235 (v4) | mA*mC*mU*mGmGmCmGmCUUCUmAmUmCmUmGmAmUUACUCUGmAmGmCmGmCmCmAmUmCmAmCmCAGCGAmCmUAUmGmUmCmGUAGUGmGmGmUmAmAmAmGmCmCmGmCmUmUmAmCmGmGmAmCmUmUmCmGmGmUmCmCmGmUmAmAmGmAmGmGmCmAmUCAGAGNNNNNNNNNNNNNNNNNmN*mN*mN | 2961 |
| 235 (v5) | mA*mC*mU*GGCGCUUCUAUCUGAUUACUCUGAGCGCCAUCACCAGCGAmCmUAUmGmUmCmGUAGUGGGUmAmAmAmGmCmCmGmCmUmUmAmCmGmGmAmCmUmUmCmGmGmUmCmCmGmUmAmAmGmAmGmGmCAUCAGAGNNNNNNNNNNNNNNNNNNmN*mN*mN | 2962 |
| 235 (v6) | mA*mC*mU*GGCGCUUCUAUCUGAUUACUCUGAGCGCCAUCACCAGCGACUAUGUCGUAGUGGGUmAmAmAmGmCmCmGmCmUmUmAmCmGmGmAmCmUmUmCmGmGmUmCmCmGmUmAmAmGmAmGmGmCAUCAGAGNNNNNNNNNNNNNNNNNNmN*mN*mN | 2963 |
| 235 (v7) | mA*mC*mU*GGmCGmCmUUCUAmUmCUGAUUACUCUGmAmGCGCCmAmUmCmAmCCAGCmGmAmCmUAUmGmUmCmGUAGUGGmGmUmAmAAmGmCmCmGmCmUmUmAmCmGmGmAmCmUmUmCmGmGmUmCmCmGmUmAmAmGmAmGmGmCmAmUCAGAGNNNNNNNNNNNNNNNNN*mN*mN*mN | 2964 |
| 235 (v8) | mA*mC*mU*GGCGCUUCUAUCUGAUUACUCUGAGCGCCmAmUmCmAmCCAGCmGmAmCmUAUmGmUmCmGUAGUGGmGmUmAmAAmGmCmCmGmCmUmUmAmCmGmGmAmCmUmUmCmGmGmUmCmCmGmUmAmAmGmAmGmGmCmAmUCAGAGNNNNNNNNNNNNNNNNN*mN*mN*mN | 2965 |
| 235 (v9) | mA*mC*mU*GGmCGmCmUUCUAmUmCUGAUUACUCUGmAmGCGCCAUCACCAGCmGmAmCmUAUmGmUmCmGUAGUGGGUAAAmGmCmCmGmCmUmUmAmCmGmGmAmCmUmUmCmGmGmUmCmCmGmUmAmAmGmAmGmGmCAUCAGAGNNNNNNNNNNNNNNNNN*mN*mN*mN | 2966 |
| 316 (v0) | ACUGGCGCUUCUAUCUGAUUACUCUGAGCGCCAUCACCAGCGACUAUGUCGUAGUGGGUAAAGCUCCCUCUUCGGAGGGAGCAUCAGAGNNNNNNNNNNNNNNNNNNNN | 2967 |
| 316 (v1) | mA*mC*mU*GGCGCUUCUAUCUGAUUACUCUGAGCGCCAUCACCAGCGACUAUGUCGUAGUGGGUAAAGCUCCCUCUUCGGAGGGAGCAUCAGAGNNNNNNNNNNNNNNNNN*mN*mN*mN | 2968 |
| 316 (v2) | mA*mC*mU*GGCGCUUCUAUCUGAUUACUCUGAGCGCCAUCACCAGCGACUAUGUCGUAGUGGGUAAAGCUCCCUCUUCG | 2969 |

TABLE 25-continued

Sequences of gRNA scaffolds with their different chemical modification profiles (denoted by version number), where "NNNNNNNNNNNNNNNNNNNN" is a spacer placeholder. Chemical modifications: * = phosphorothioate bond; m = 2'OMe modification

| gRNA scaffold (version) | gRNA sequence | SEQ ID NO: |
|---|---|---|
| | GAGGGAGCAUCAGAGNNNNNNNNNNNNNNNNNNNNN*mU*mU*mU | |
| 316 (v3) | mA*mC*mU*mGmGmCmGmCmUmUmCmUmAmUmCmUmGmAmUUACUCUGmAmGmCmGmCmCmAmUmCmAmCmCAGCGAmCmUAUmGmUmCmGUAGUGmGmGmUmAmAmAmGmCmUmCmCmCmUmCmUmUmCmGmGmAmGmGmGmAmGmCmAmUmCmAGAGNNNNNNNNNNNNNNNNNN*mN*mN*mN | 2970 |
| 316 (v4) | mA*mC*mU*mGmGmCmGmCUUCUmAmUmCmUmGmAmUUACUCUGmAmGmCmGmCmCmAmUmCmAmCmCAGCGAmCmUAUmGmUmCmGUAGUGmGmGmUmAmAmAmGmCmUmCmCmCmUmCmUmUmCmGmGmAmGmGmGmAmGmCmAmUCAGAGNNNNNNNNNNNNNNNNN*mN*mN*mN | 2971 |
| 316 (v5) | mA*mC*mU*GGCGCUUCUAUCUGAUUACUCUGAGCGCCAUCACCAGCGAmCmUAUmGmUmCmGUAGUGGGUAAAmGmCmUmCmCmCmUmCmUmUmCmGmGmAmGmGmGmAmGmCAUCAGAGNNNNNNNNNNNNNNNNNN*mN*mN*mN | 2972 |
| 316 (v6) | mA*mC*mU*GGCGCUUCUAUCUGAUUACUCUGAGCGCCAUCACCAGCGACUAUGUCGUAGUGGGUAAAmGmCmUmCmCmCmUmCmUmUmCmGmGmAmGmGmGmAmGmCAUCAGAGNNNNNNNNNNNNNNNNNN*mN*mN*mN | 2973 |
| 316 (v7) | mA*mC*mU*GGmCGmCmUUCUAmUmCUGAUUACUCUGmAmGCGCCmAmUmCmAmCCAGCmGmAmCmUAUmGmUmCmGUAGUGGmGmUmAmAAmGmCmUmCmCmCmUmCmUmUmCmGmGmAmGmGmGmAmGmCmAmUCAGAGNNNNNNNNNNNNNNNNNN*mN*mN*mN | 2974 |
| 316 (v8) | mA*mC*mU*GGCGCUUCUAUCUGAUUACUCUGAGCGCCmAmUmCmAmCCAGCmGmAmCmUAUmGmUmCmGUAGUGGmGmUmAmAAmGmCmUmCmCmCmUmCmUmUmCmGmGmAmGmGmGmAmGmCmAmUCAGAGNNNNNNNNNNNNNNNNN*mN*mN*mN | 2975 |
| 316 (v9) | mA*mC*mU*GGmCGmCmUUCUAmUmCUGAUUACUCUGmAmGCGCCAUCACCAGCmGmAmCmUAUmGmUmCmGUAGUGGGUAAAmGmCmUmCmCmCmUmCmUmUmCmGmGmAmGmGmGmAmGmCAUCAGAGNNNNNNNNNNNNNNNNN*mN*mN*mN | 2976 |

TABLE 26

Sequences of gRNAs with their different chemical modification profiles (denoted by version number) assayed in this example. Chemical modifications: * = phosphorothioate bond; m = 2'Ome modification

| gRNA ID (scaffold variant-spacer) | Target | gRNA sequence | SEQ ID NO: |
|---|---|---|---|
| 174-6.7 (v0) | human PCSK9 | ACUGGCGCUUUUAUCUGAUUACUUUGAGAGCCAUCACCAGCGACUAUGUCGUAGUGGGUAAAGCUCCCUCUUCGGAGGGAGCAUCAAAGUCCUGGCUUCCUGGUGAAGA | 3145 |
| 174-6.7 (v1) | human PCSK9 | mA*mC*mU*GGCGCUUUUAUCUGAUUACUUUGAGAGCCAUCACCAGCGACUAUGUCGUAGUGGGUAAAGCUCCCUCUUCGGAGGGAGCAUCAAAGUCCUGGCUUCCUGGUGAmA*mG*mA | 3074 |
| 174-6.8 (v0) | human PCSK9 | ACUGGCGCUUUUAUCUGAUUACUUUGAGAGCCAUCACCAGCGACUAUGUCGUAGUGGGUAAAGCUCCCUCUUCGGAGGGAGCAUCAAAGUGGCUUCCUGGUGAAGAUGA | 3146 |
| 174-6.8 (v1) | human PCSK9 | mA*mC*mU*GGCGCUUUUAUCUGAUUACUUUGAGAGCCAUCACCAGCGACUAUGUCGUAGUGGGUAAAGCUCCCUCUUCGGAGGGAGCAUCAAAGUGGCUUCCUGGUGAAGAmU*mG*mA | 3147 |
| 174-7.9 (v0) | human B2M | ACUGGCGCUUUUAUCUGAUUACUUUGAGAGCCAUCACCAGCGACUAUGUCGUAGUGGGUAAAGCUCCCUCUUCGGAGGGAGCAUCAAAGGUGUAGUACAAGAGAUAGAA | 3148 |
| 174-7.9 (v1) | human B2M | mA*mC*mU*GGCGCUUUUAUCUGAUUACUUUGAGAGCCAUCACCAGCGACUAUGUCGUAGUGGGUAAAGCUCCCUCUUCGGAGGGAGCAUCAAAGGUGUAGUACAAGAGAUAmG*mA*mA | 3149 |
| 316-6.7 (v0) | human PCSK9 | ACUGGCGCUUCUAUCUGAUUACUCUGAGCGCCAUCACCAGCGACUAUGUCGUAGUGGGUAAAGCUCCCUCUUCGGAGGGA | 3150 |

TABLE 26-continued

Sequences of gRNAs with their different chemical modification profiles (denoted by version number) assayed in this example. Chemical modifications: * = phosphorothioate bond; m = 2'Ome modification

| gRNA ID (scaffold variant-spacer) | Target | gRNA sequence | SEQ ID NO: |
|---|---|---|---|
| | | GCAUCAGAGUCCUGGCUUCCUGGUGAAGA | |
| 316-6.7 (v1') | human PCSK9 | mA*mC*mU*GGCGCUUCUAUCUGAUUACUCUGAGCGCCAUCACCAGCGACUAUGUCGUAGUGGGUAAAGCUCCCUCUUCGGAGGGAGCAUCAGAGUCCUGGCUUCCUGGUGAmA*mG*mA | 3151 |
| 316-6.8 (v0) | human PCSK9 | ACUGGCGCUUCUAUCUGAUUACUCUGAGCGCCAUCACCAGCGACUAUGUCGUAGUGGGUAAAGCUCCCUCUUCGGAGGGAGCAUCAGAGUGGCUUCCUGGUGAAGAUGA | 3152 |
| 316-6.8 (v1') | human PCSK9 | mA*mC*mU*GGCGCUUCUAUCUGAUUACUCUGAGCGCCAUCACCAGCGACUAUGUCGUAGUGGGUAAAGCUCCCUCUUCGGAGGGAGCAUCAGAGUGGCUUCCUGGUGAAGAmU*mG*mA | 3153 |
| 316-7.9 (v0) | human B2M | ACUGGCGCUUCUAUCUGAUUACUCUGAGCGCCAUCACCAGCGACUAUGUCGUAGUGGGUAAAGCUCCCUCUUCGGAGGGAGCAUCAGAGGUGUAGUACAAGAGAUAGAA | 3154 |
| 316-7.9 (v1') | human B2M | mA*mC*mU*GGCGCUUCUAUCUGAUUACUCUGAGCGCCAUCACCAGCGACUAUGUCGUAGUGGGUAAAGCUCCCUCUUCGGAGGGAGCAUCAGAGGUGUAGUACAAGAGAUAmG*mA*mA | 3155 |
| 174-7.37 (v0) | human B2M | ACUGGCGCUUUUAUCUgAUUACUUUGAGAGCCAUCACCAGCGACUAUGUCGUAgUGGGUAAAGCUCCCUCUUCGGAGGGAGCAUCAAAGGGCCGAGAUGUCUCGCUC | 3156 |
| 174-7.37 (v1*) | human B2M | mA*mC*mU*GGCGCUUUUAUCUgAUUACUUUGAGAGCCAUCACCAGCGACUAUGUCGUAgUGGGUAAAGCUCCCUCUUCGGAGGGAGCAUCAAAGGGCCGAGAUGUCUCG*mC*mU*mC | 3157 |
| 235-6.7 (v0) | human PCSK9 | ACUGGCGCUUCUAUCUGAUUACUCUGAGCGCCAUCACCAGCGACUAUGUCGUAGUGGGUAAAGCCGCUUACGGACUUCGGUCCGUAAGAGGCAUCAGAGUCCUGGCUUCCUGGUGAAGA | 3158 |
| 235-6.7 (v1) | human PCSK9 | mA*mC*mU*GGCGCUUCUAUCUGAUUACUCUGAGCGCCAUCACCAGCGACUAUGUCGUAGUGGGUAAAGCCGCUUACGGACUUCGGUCCGUAAGAGGCAUCAGAGUCCUGGCUUCCUGGUGAmA*mG*mA | 3159 |
| 235-6.7 (v2) | human PCSK9 | mA*mC*mU*GGCGCUUCUAUCUGAUUACUCUGAGCGCCAUCACCAGCGACUAUGUCGUAGUGGGUAAAGCCGCUUACGGACUUCGGUCCGUAAGAGGCAUCAGAGUCCUGGCUUCCUGGUGAAGAU*mU*mU*mU | 3160 |
| 235-6.7 (v3) | human PCSK9 | mA*mC*mU*mGmGmCmGmCmUmUmCmUmAmUmCmUmGmAmUUACUCUGmAmGmCmGmCmCmAmUmCmAmCmCAGCGAmCmUAUmGmUmCmGUAGUGmGmGmUmAmAmAmGmCmCmGmCmUmUmAmCmGmGmAmCmUmUmCmGmGmUmCmCmGmUmAmAmGmAmGmGmCmAmUmCmAGAGUCCUGGCUUCCUGGUGAmA*mG*mA | 3161 |
| 235-6.7 (v4) | human PCSK9 | mA*mC*mU*mGmGmCmGmCUUCUmAmUmCmUmGmAmUUACUCUGmAmGmCmGmCmCmAmUmCmAmCmCAGCGAmCmUAUmGmUmCmGUAGUGmGmGmUmAmAmAmGmCmCmGmCmUmUmAmCmGmGmAmCmUmUmCmGmGmUmCmCmGmUmAmAmGmAmGmGmCmAmUCAGAGUCCUGGCUUCCUGGUGAmA*mG*mA | 3162 |
| 235-6.7 (v5) | human PCSK9 | mA*mC*mU*GGCGCUUCUAUCUGAUUACUCUGAGCGCCAUCACCAGCGAmCmUAUmGmUmCmGUAGUGGGUmAmAmAmGmCmCmGmCmUmUmAmCmGmGmAmCmUmUmCmGmGmUmCmCmGmUmAmAmGmAmGmGmCAUCAGAGUCCUGGCUUCCUGGUGAmA*mG*mA | 3163 |
| 235-6.7 (v6) | human PCSK9 | mA*mC*mU*GGCGCUUCUAUCUGAUUACUCUGAGCGCCAUCACCAGCGACUAUGUCGUAGUGGGUmAmAmAmGmCmCmGmCmUmUmAmCmGmGmAmCmUmUmCmGmGmUmCmCmGmUmAmAmGmAmGmGmCAUCAGAGUCCUGGCUUCCUGGUGAmA*mG*mA | 3164 |
| 235-6.8 (v0) | human PCSK9 | ACUGGCGCUUCUAUCUGAUUACUCUGAGCGCCAUCACCAGCGACUAUGUCGUAGUGGGUAAAGCCGCUUACGGACUUCGGUCCGUAAGAGGCAUCAGAGUGGCUUCCUGGUGAAGAUGA | 3165 |
| 235-6.8 (v1) | human PCSK9 | mA*mC*mU*GGCGCUUCUAUCUGAUUACUCUGAGCGCCAUCACCAGCGACUAUGUCGUAGUGGGUAAAGCCGCUUACGGACUUCGGUCCGUAAGAGGCAUCAGAGUGGCUUCCUGGUGAAGAmU*mG*mA | 3166 |

TABLE 26-continued

Sequences of gRNAs with their different chemical modification profiles (denoted by version number) assayed in this example. Chemical modifications: * = phosphorothioate bond; m = 2'Ome modification

| gRNA ID (scaffold variant-spacer) | Target | gRNA sequence | SEQ ID NO: |
|---|---|---|---|
| 235-6.8 (v2) | human PCSK9 | mA*mC*mU*GGCGCUUCUAUCUGAUUACUCUGAGCGCCAUCACCAGCGACUAUGUCGUAGUGGGUAAAGCCGCUUACGGACUUCGGUCCGUAAGAGGCAUCAGAGUGGCUUCCUGGUGAAGAUGA*mU*mU*mU | 3167 |
| 235-6.8 (v3) | human PCSK9 | mA*mC*mU*mGmGmCmGmCmUmUmCmUmAmUmCmUmGmAmUUACUCUGmAmGmCmGmCmCmAmUmCmAmCmCAGCGAmCmUAUmGmUmCmGUAGUGmGmGmUmAmAmAmGmCmCmGmCmUmUmAmCmGmGmAmCmUmUmCmGmGmUmCmCmGmUmAmAmGmAmGmGmCmAmUmCmAGAGUGGCUUCCUGGUGAAGAmU*mG*mA | 3168 |
| 235-6.8 (v4) | human PCSK9 | mA*mC*mU*mGmGmCmGmCUUCUmAmUmCmUmGmAmUUACUCUGmAmGmCmGmCmCmAmUmCmAmCmCAGCGAmCmUAUmGmUmCmGUAGUGmGmGmUmAmAmAmGmCmCmGmCmUmUmAmCmGmGmAmCmUmUmCmGmGmUmCmCmGmUmAmAmGmAmGmGmCmAmUCAGAGUGGCUUCCUGGUGAAGAmU*mG*mA | 3169 |
| 235-6.8 (v5) | human PCSK9 | mA*mC*mU*GGCGCUUCUAUCUGAUUACUCUGAGCGCCAUCACCAGCGAmCmUAUmGmUmCmGUAGUGGGUmAmAmAmGmCmCmGmCmUmUmAmCmGmGmAmCmUmUmCmGmGmUmCmCmGmUmAmAmGmAmGmGmCAUCAGAGUGGCUUCCUGGUGAAGAmU*mG*mA | 3170 |
| 235-6.8 (v6) | human PCSK9 | mA*mC*mU*GGCGCUUCUAUCUGAUUACUCUGAGCGCCAUCACCAGCGACUAUGUCGUAGUGGGUmAmAmAmGmCmCmGmCmUmUmAmCmGmGmAmCmUmUmCmGmGmUmCmCmGmUmAmAmGmAmGmGmCAUCAGAGUGGCUUCCUGGUGAAGAmU*mG*mA | 3171 |
| 316-27.107 (v0) | mouse PCSK9 | ACUGGCGCUUCUAUCUGAUUACUCUGAGCGCCAUCACCAGCGACUAUGUCGUAGUGGGUAAAGCUCCCUCUUCGGAGGGAGCAUCAGAGCUGGCUUCUUGGUGAAGAUG | 3172 |
| 316-27.107 (v1) | mouse PCSK9 | mA*mC*mU*GGCGCUUCUAUCUGAUUACUCUGAGCGCCAUCACCAGCGACUAUGUCGUAGUGGGUAAAGCUCCCUCUUCGGAGGGAGCAUCAGAGCUGGCUUCUUGGUGAAG*mA*mU*mG | 3173 |
| 316-27.107 (v7) | mouse PCSK9 | mA*mC*mU*GGmCGmCmUUCUAmUmCUGAUUACUCUGmAmGCGCCmAmUmCmAmCCAGCmGmAmCmUAUmGmUmCmGUAGUGGmGmUmAmAAmGmCmUmCmCmCmUmCmUmUmCmGmGmAmGmGmGmAmGmCmAmUCAGAGCUGGCUUCUUGGUGAAG*mA*mU*mG | 3174 |
| 316-27.107 (v8) | mouse PCSK9 | mA*mC*mU*GGCGCUUCUAUCUGAUUACUCUGAGCGCCmAmUmCmAmCCAGCmGmAmCmUAUmGmUmCmGUAGUGGmGmUmAmAAmGmCmUmCmCmCmUmCmUmUmCmGmGmAmGmGmGmAmGmCmAmUCAGAGCUGGCUUCUUGGUGAAG*mA*mU*mG | 3175 |
| 316-27.107 (v9*) | mouse PCSK9 | mA*mC*mU*GGmCGmCmUUCUAmUmCUGAUUACUCUGmAmGCGCCAUCACCAGCmGmAmCmUAUmGmUmCmGUAGUGGGUAAAmGmCmUmCmCmCmUmCmUmUmCmGmGmAmGmGmGmAmGmCAUCAGAGCUGGCUUCUUGGUGAA*mG*mA*mU*mG | 3176 |
| 174-35.2 (v0) | ROSA26 | ACUGGCGCUUUUAUCUGAUUACUUUGAGAGCCAUCACCAGCGACUAUGUCGUAGUGGGUAAAGCUCCCUCUUCGGAGGGAGCAUCAAAGAGAAGAUGGGCGGGAGUCUU | 3177 |
| 174-35.2 (v2) | ROSA26 | mA*mC*mU*GGCGCUUUUAUCUGAUUACUUUGAGAGCCAUCACCAGCGACUAUGUCGUAGUGGGUAAAGCUCCCUCUUCGGAGGGAGCAUCAAAGAGAAGAUGGGCGGGAGUCUU*mU*mU*mU | 3178 |
| 316-35.2 (v0) | ROSA26 | ACUGGCGCUUCUAUCUGAUUACUCUGAGCGCCAUCACCAGCGACUAUGUCGUAGUGGGUAAAGCUCCCUCUUCGGAGGGAGCAUCAGAGAGAAGAUGGGCGGGAGUCUU | 3179 |
| 316-35.2 (v1) | ROSA26 | mA*mC*mU*GGCGCUUCUAUCUGAUUACUCUGAGCGCCAUCACCAGCGACUAUGUCGUAGUGGGUAAAGCUCCCUCUUCGGAGGGAGCAUCAGAGAGAAGAUGGGCGGGAGU*mC*mU*mU | 3180 |
| 316-35.2 (v5) | ROSA26 | mA*mC*mU*GGCGCUUCUAUCUGAUUACUCUGAGCGCCAUCACCAGCGAmCmUAUmGmUmCmGUAGUGGGUAAAmGmCmUmCmCmCmUmCmUmUmCmGmGmAmGmGmGmAmGmCAUCAGAGAGAAGAUGGGCGGGAGU*mC*mU*mU | 3181 |

Note that gRNAs annotated with a v1' design contain one less phosphorothioate bond on the 3' end of the gRNA. gRNAs annotated with v1* contain one extra phosphorothioate bond on the 3'end of the gRNA. gRNAs annotated with a v9* contain an extra phosphorothioate bond on the 3' end of the gRNA.

Biochemical Characterization of gRNA Activity:

Target DNA oligonucleotides with fluorescent moieties on the 5' ends were purchased commercially (sequences listed in Table 27). Double-stranded DNA (dsDNA) targets were formed by mixing the oligos in a 1:1 ratio in 1× cleavage buffer (20 mM Tris HCl PH 7.5, 150 mM NaCl, 1 mM TCEP, 5% glycerol, 10 mM $MgCl_2$), following by heating to 95° C. for 10 minutes, and then allowing the solution to cool to room temperature. CasX ribonucleoproteins (RNPs) were reconstituted with CasX 491 and the indicated gRNAs at a final concentration of 1 μM with 1.2-fold excess of the indicated gRNA in 1x cleavage buffer. RNPs were allowed to form at 37° C. for 10 minutes.

The effects of various structural and chemical modifications to the gRNA scaffold on the cleavage rate of CasX 491 RNPs were determined. Cleavage reactions were prepared with final RNP concentrations of 200 nM and final target concentrations of 10 nM, and reactions were carried out at 16° C. and initiated by the addition of the labeled target DNA substrate (Table 27). Aliquots of reactions were taken at 0.25, 0.5, 1, 2, 5, and 10 minutes and quenched by adding an equal volume of 95% formamide with 20 mM EDTA. Samples were denatured at 95° C. for 10 minutes and resolved on a 10% urea-PAGE gel. Gels were imaged on a Typhoon™ laser-scanner platform and quantified using ImageQuant™ TL 8.2 image analysis software (Cytiva™). The apparent first-order rate constant of non-target strand cleavage ($k_{cleave-}$) was determined for each CasX:gRNA combination.

To determine the competent fraction formed by each gRNA, cleavage reactions were prepared with final RNP concentrations of 100 nM and final target concentrations of 100 nM. Reactions were carried out at 37° C. and initiated by the addition of the labeled target substrate (Table 27). Aliquots were taken at 0.5, 1, 2, 5, 10, and 30 minutes and quenched by adding an equal volume of 95% formamide with 25 mM EDTA. Samples were denatured by heating at 95° C. for 10 minutes and resolved on a 10% urea-PAGE gel. Gels were imaged and quantified as above. CasX was assumed to act as a single-turnover enzyme under the assayed conditions, as indicated by the observation that sub-stoichiometric amounts of enzyme would fail to cleave a greater-than-stoichiometric amount of target substrate even under extended time-scales, and instead would approach a plateau that scaled with the amount of enzyme present. Thus, the fraction of target substrate cleaved over long time-scales by an equimolar amount of RNP would be indicative of the fraction of RNP that was properly formed and active for cleavage. The cleavage traces were fitted with a biphasic rate model, as the cleavage reaction clearly deviated from monophasic under this concentration regime. The plateau of each fit was determined and reported as the active fraction for each RNP in Table 30.

TABLE 27

Sequences of target DNA substrate oligonucleotides with fluorescent moieties on the 5' ends used for biochemical characterization of gRNA activity. /700/ = IRDye700; /800/ = IRDye800

| DNA substrate | Sequence |
|---|---|
| 6.7/6.8 target top strand (SEQ ID NO: 3182) | /700/catgtcttccatggccttcttcctggcttcctggtgaagatgagtggcgacctgctggag |
| 6.7/6.8 target bottom strand (SEQ ID NO: 3183) | /800/ctccagcaggtcgccactcatcttcaccaggaagccaggaagaaggccatggaagacatg |

In Vitro Transcription of CasX mRNA:

DNA templates encoding for CasX 491 (see Table 28 for encoding sequences) used for in vitro transcription were generated by PCR using forward primers containing a T7 promoter, followed by agarose gel extraction of the appropriately sized DNA. 25 ng/μL final concentration of template DNA was used in each in vitro transcription reaction that was carried out following the manufacturer's recommended protocol with slight modifications. Following in vitro transcription reaction incubation for 2-3 hours at 37° C., which were carried out with CleanCap® AG and N1-methyl-pseudouridine, DNAse digestion of template DNA and column-based purification using the Zymo RNA miniprep kit were performed. The poly(A) tail was added using *E. coli* PolyA Polymerase following the manufacturer's protocol, followed by column-based purification as stated above. Poly(A) tailed in vitro transcribed RNA was eluted in RNAse free water, analyzed on an Agilent® TapeStation® for integrity, and flash frozen prior to storage at −80° C.

TABLE 28

Encoding sequences of the CasX mRNA molecules assessed in this example*.

| CasX 491 mRNA ID | Component (ID) | DNA sequence or SEQ ID NO: |
|---|---|---|
| CasX 491 mRNA #1 | 5'UTR | 3082 |
| | START codon + c-MYC NLS + linker | 3184 |
| | CasX 491 | 3185 |
| | Linker + c-MYC NLS | 3186 |
| | P2A mScarlet + STOP codon | 3187 |
| CasX 676 mRNA #2 | 5'UTR | 3047 |
| | START codon + c-MYC NLS | 3133 |
| | CasX 676 | 3134 |
| | c-MYC NLS + STOP codons | 3135 |
| | 3'UTR | 3055 |

TABLE 28-continued

| Encoding sequences of the CasX mRNA molecules assessed in this example*. | | |
|---|---|---|
| CasX 491 mRNA ID | Component (ID) | DNA sequence or SEQ ID NO: |
| | XbaI restriction site (partial) | TCTAG |
| | Poly(A) tail | 3057 |

*Components are listed in a 5' to 3' order within the constructs

Figure 20:
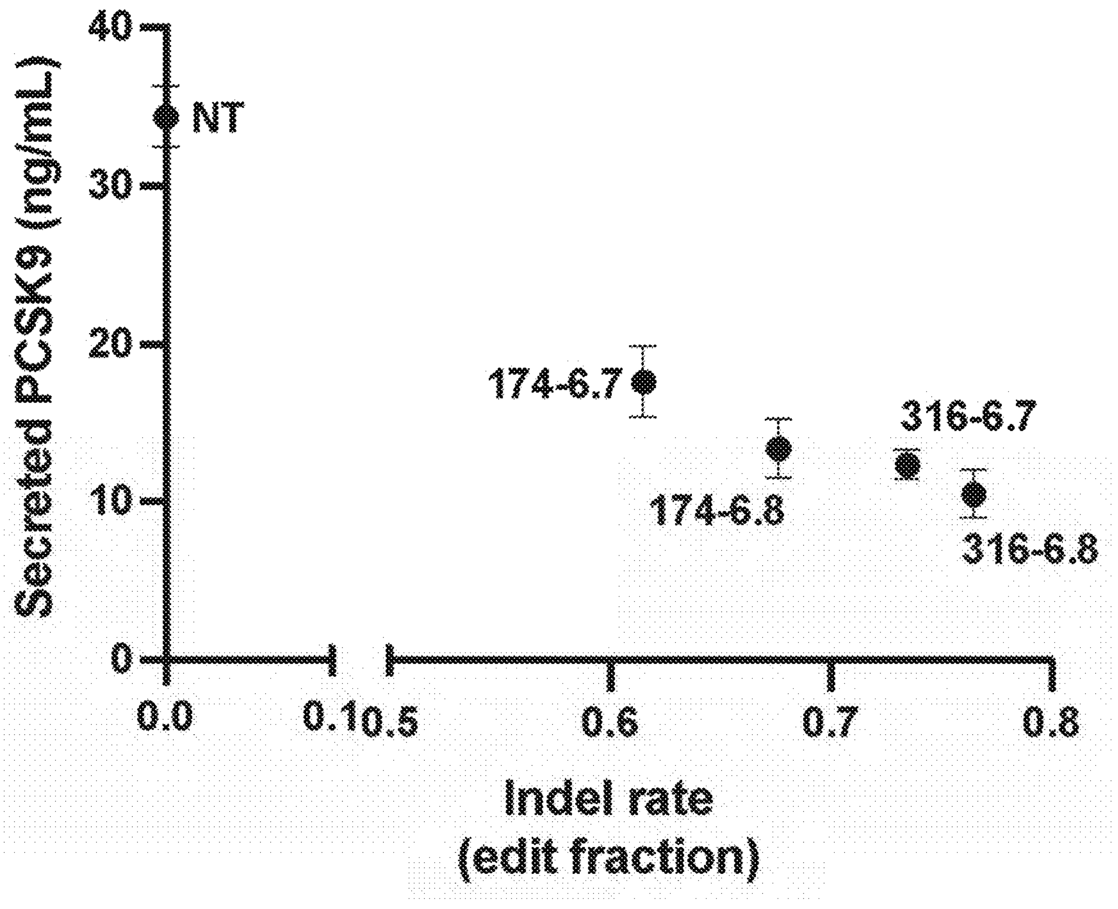
FIG. 20 is a plot displaying a correlation between indel rate (depicted as edit fraction) at the PCSK9 locus as measured by next-generation sequencing (NGS) (x-axis) and secreted PCSK9 levels (ng/ml) detected by enzyme-linked immunosorbent assay (ELISA) (y-axis) in HepG2 cells lipofected with CasX 491 mRNA and PCSK9-targeting gRNAs containing the indicated scaffold variant and spacer combination, as described in Example 7.

In Vitro Delivery of gRNA and CasX mRNA Via Transfection:

Editing at the PCSK9 locus and consequential effects on secreted PCSK9 levels were assessed for conditions using CasX 491 mRNA co-delivered with a PCSK9-targeting gRNA with scaffold variant 174 compared to conditions where a PCSK9-targeting gRNA with scaffold variant 316 was used. 100 ng of in vitro transcribed mRNA coding for CasX 491 with a P2A and mScarlet fluorescent protein was transfected into HepG2 cells with version 1 (v1) of gRNAs 174-6.7, 174-6.8, 316-6.7, and 316-6.8 (see Table 26) using Lipofectamine™. After a media change, the following were harvested at 28 hours post-transfection: 1) transfected cells were harvested for editing assessment at the PCSK9 locus by NGS (next generation sequencing); and 2) media supernatant was harvested to measure secreted PCSK9 protein levels by ELISA. For editing analysis by NGS, amplicons were amplified from 200 ng of extracted gDNA with a set of primers targeting the PCSK9 locus and processed by NGS (described below). Secreted PCSK9 levels in the media supernatant were also analyzed using a fluorescence resonance energy transfer-based immunoassay from CISBio following the manufacturer's instructions. Here, a gRNA using scaffold 174 with spacer 7.37 (v0; see Table 26), which targeted the endogenous B2M (beta-2-microglobulin) locus, served as the non-targeting (NT) control. These results are shown in FIG. 20.

Figure 17:
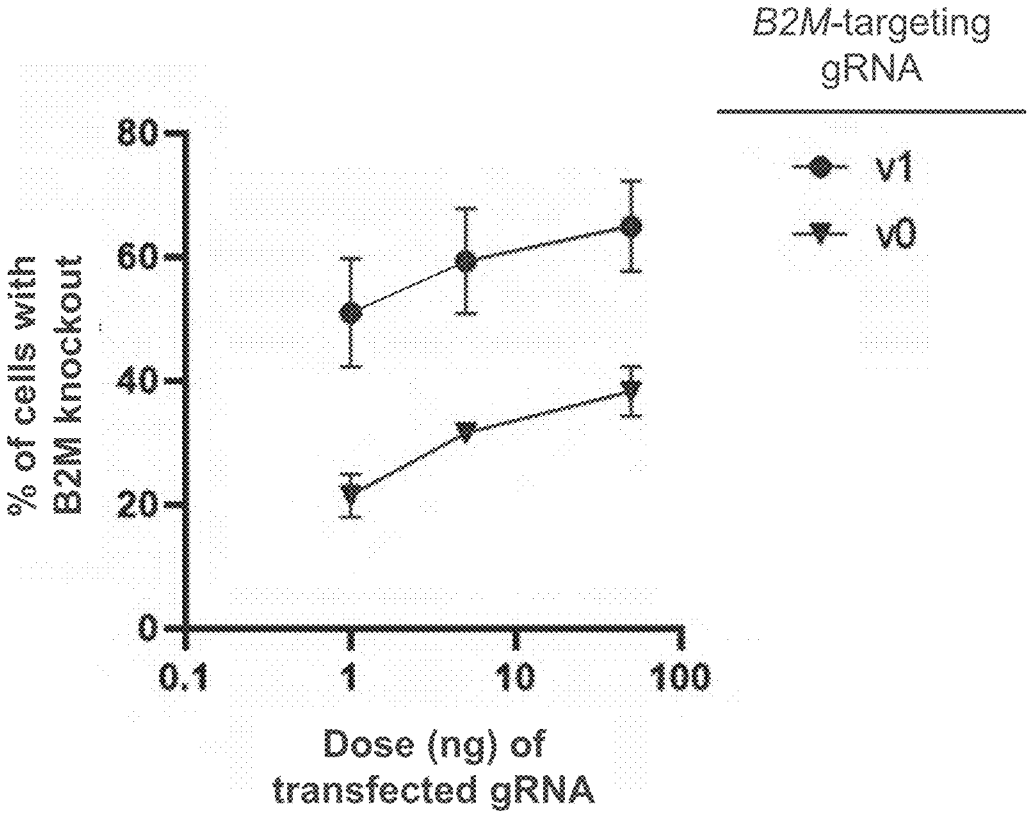
FIG. 17 is a plot illustrating the quantification of percent knockout of B2M in HepG2 cells co-transfected with 100 ng of CasX 491 mRNA and with the indicated doses of end-modified (v1) or unmodified (v0) B2M-targeting gRNAs with spacer 7.37, as described in Example 7. Editing level was determined by flow cytometry as the population of cells with loss of surface presentation of the HLA complex due to successful editing at the B2M locus.

To compare the editing potency of version 0 (v0) and version 1 (v1) of B2M-targeting gRNAs, ~6E4 HepG2 hepatocytes were seeded per well of a 96-well plate. 24 hours later, seeded cells were co-transfected using Lipofectamine™ with 100 ng of in vitro transcribed mRNA coding for CasX 491 and different doses (1, 5, or 50 ng) of either v0 or v1 of the B2M-targeting gRNA containing scaffold variant 174 and spacer 7.37 (see Table 26). Six days post-transfection, cells were harvested for B2M protein expression analysis via immunostaining of the B2M-dependent HLA protein, followed by flow cytometry using the Attune™ NxT flow cytometer. These results are shown in FIG. 17.

V1 through v6 variants of chemically-modified PCSK9-targeting gRNAs (Table 26) were assessed for their effects on editing potency and consequential effects on secreted PCSK9 levels in vitro. Briefly, 100 ng of in vitro transcribed mRNA coding for CasX variant 491 and a P2A and mScarlet fluorescent protein was transfected into HepG2 cells with 50 ng of the indicated chemically-modified gRNA using Lipofectamine™. After a media change, the following were harvested at 28 hours post-transfection: 1) transfected cells for editing assessment at the PCSK9 locus by NGS as described above; and 2) media supernatant to measure secreted PCSK9 protein levels by ELISA, as described above. Here, a B2M-targeting gRNA was used as a non-targeting control. These results are shown in Table 31.

NGS Processing and Analysis:

Genomic DNA (gDNA) from harvested cells were extracted using the Zymo Quick-DNA Miniprep Plus kit following the manufacturer's instructions. Target amplicons were formed by amplifying regions of interest from ~50-200 ng of extracted gDNA with a set of primers targeting the human PCSK9 locus. These gene-specific primers contained an additional sequence at the 5' ends to introduce Illumina reads 1 and 2 sequences. Further, they contained a 16-nucleotide random sequence that functioned as a unique molecular identifier (UMI). The quality and quantification of the amplicon was assessed using a Fragment Analyzer DNA analyzer kit (Agilent®, dsDNA 35-1500 bp). Amplicons were sequenced on the Illumina MiSeq™ according to the manufacturer's instructions. Raw fastq sequencing files were processed by trimming for quality and adapter sequences and merging read 1 and read 2 into a single insert sequence; insert sequences were then analyzed by the CRISPResso2 (v 2.0.29) program. The percentage of reads modified in a window around the 3' end of the spacer was determined. The activity of the CasX molecule was quantified as the total percent of reads that contain insertions, substitutions, and/or deletions anywhere within this window for each.

Formulations of Lipid Nanoparticles (LNPs):

CasX mRNA and gRNA were encapsulated into LNPs using Gen Voy-ILM™ lipids on the Precision NanoSystems Inc. (PNI) Ignite™ Benchtop System and following the manufacturer's guidelines. Gen Voy-ILM™ lipids are manufactured by PNI, with a proprietary composition of ionizable lipid:DSPC:cholesterol:stabilizer at 50:10:37.5:2.5 mol %.

Briefly, to formulate LNPs, equal mass ratios of CasX mRNA and gRNA were diluted in PNI Formulation Buffer, pH 4.0. Gen Voy-ILM™ was diluted 1:1 in anhydrous ethanol. mRNA/gRNA co-formulations were performed using a predetermined N/P ratio. The RNA and lipids were run through a PNI laminar flow cartridge at a predetermined flow rate ratio (RNA:Genvoy-ILM™) on the PNI Ignite™ Benchtop System. After formulation, the LNPs were diluted in PBS, pH 7.4, to decrease the ethanol concentration and increase the pH, which increases the stability of the particles. Buffer exchange of the mRNA/sgRNA-LNPs was achieved by overnight dialysis into PBS, pH 7.4, at 4° C. using 10k Slide-A-Lyzer™ Dialysis Cassettes (Thermo Scientific™). Following dialysis, the mRNA/gRNA-LNPs were concentrated to >0.5 mg/mL using 100 kDa Amicon®-Ultra Centrifugal Filters (Millipore) and then filter-sterilized. Formulated LNPs were analyzed on a Stunner® (Unchained Labs) to determine their diameter and polydispersity index (PDI). Encapsulation efficiency and RNA concentration was determined by RiboGreen™ assay using Invitrogen's Quant-iT™ Ribogreen™ RNA assay kit. LNPs were used in various experiments as described herein to deliver CasX mRNA and gRNA to target cells and tissue.

Figure 21A:
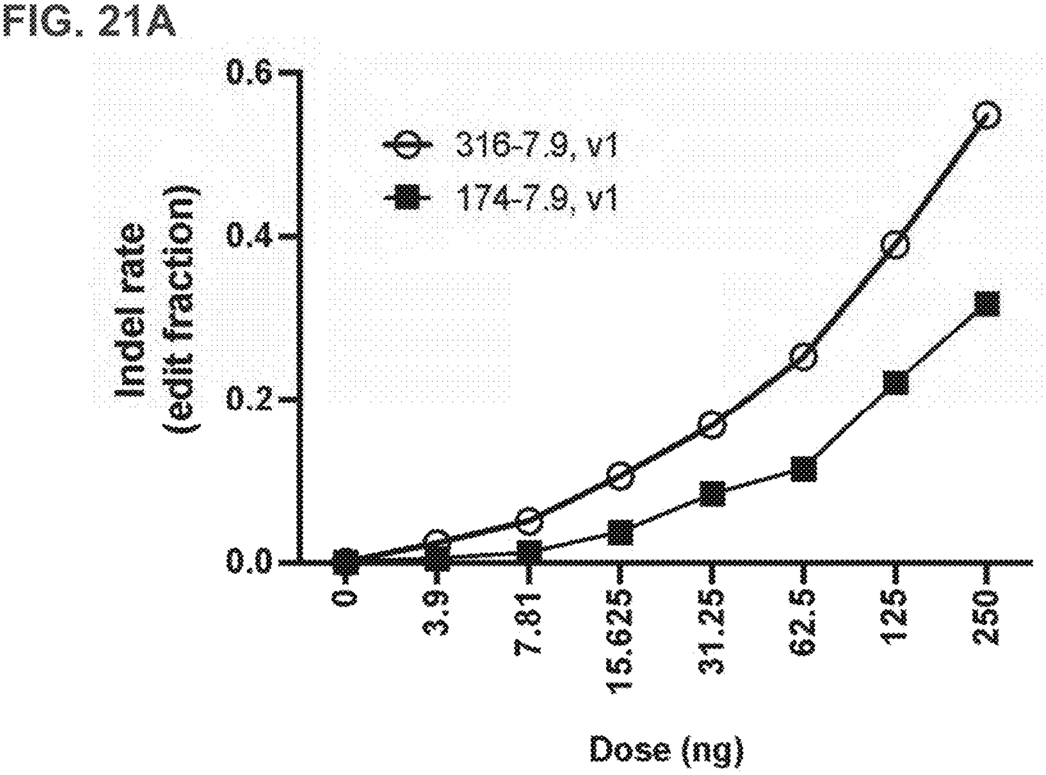
FIG. 21A is a plot depicting the results of an editing assay measured as indel rate detected by NGS at the human B2M locus in HepG2 cells treated with the indicated doses of LNPs formulated with CasX 491 mRNA and the indicated B2M-targeting gRNA, as described in Example 7.
Figure 21B:
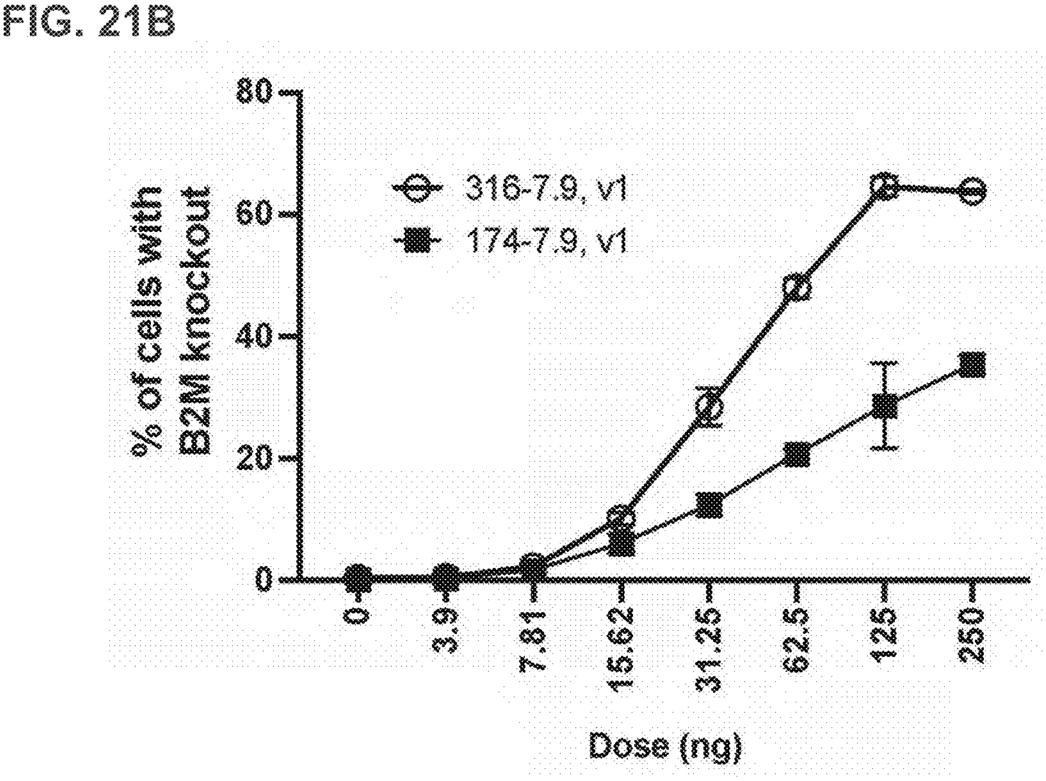
FIG. 21B is a plot illustrating the quantification of percent knockout of B2M in HepG2 cells treated with the indicated doses of LNPs formulated with CasX 491 mRNA and the indicated B2M-targeting gRNA, as described in Example 7. Editing level was determined by flow cytometry as population of cells that did not have surface presentation of the HLA complex due to successful editing at the B2M locus.

Delivery of LNPs Encapsulating CasX mRNA and Targeting gRNAs In Vitro:

~50,000 HepG2 cells, cultured in DMEM/F-12 media containing 10% FBS and 1% PenStrep, were seeded per well in a 96-well plate. The next day, seeded cells were treated with varying concentrations of LNPs, which were prepared in six 2-fold serial dilutions starting at 250 ng. These LNPs were formulated to encapsulate CasX 491 mRNA and a B2M-targeting gRNA incorporating either scaffold variant 174 or 316 with spacer 7.9 (v1; see Table 26). Media was changed 24 hours after LNP treatment, and cells were cultured for six additional days prior to harvesting for gDNA extraction for editing assessment at the B2M locus by NGS and B2M protein expression analysis via HLA immunostaining, followed by flow cytometry using the Attune NxT flow cytometer. Briefly, for editing assessment, amplicons were amplified from 200 ng of extracted gDNA with primers targeting the human B2M locus and processed by NGS using similar methods as described in Example 7. The results of these assays are shown in FIGS. 21A and 21B.

Figure 22A:
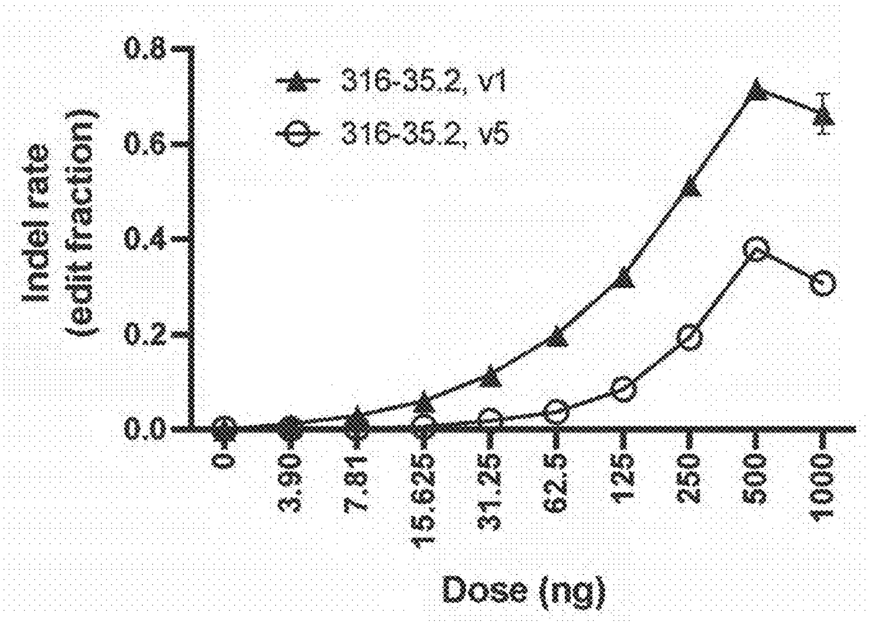
FIG. 22A is a plot depicting the results of an editing assay measured as indel rate detected by NGS at the mouse ROSA26 locus in Hepa1-6 cells treated with the indicated doses of LNPs formulated with CasX 676 mRNA #2 and the indicated ROSA26-targeting gRNA with either the v1 or v5 modification profile, as described in Example 7.

~20,000 mouse Hepa1-6 hepatocytes were seeded per well in a 96-well plate. The following day, seeded cells were treated with varying concentrations of LNPs, which were prepared in eight 2-fold serial dilutions starting at 1000 ng. These LNPs were formulated to encapsulate CasX 676 mRNA #2 (see Table 28) and a ROSA26-targeting gRNA incorporating scaffold variant 316 with spacer 35.2 (v1 or 5; see Table 26). Media was changed 24 hours post-treatment with LNPs, and cells were cultured for seven additional days prior to harvesting for gDNA extraction for editing assessment at the ROSA26 locus by NGS. Briefly, amplicons were amplified from extracted gDNA with primers targeting the mouse ROSA26 locus and processed by NGS using similar methods as described in Example 7. The results of this experiment are shown in FIG. 22A.

Figure 22B:
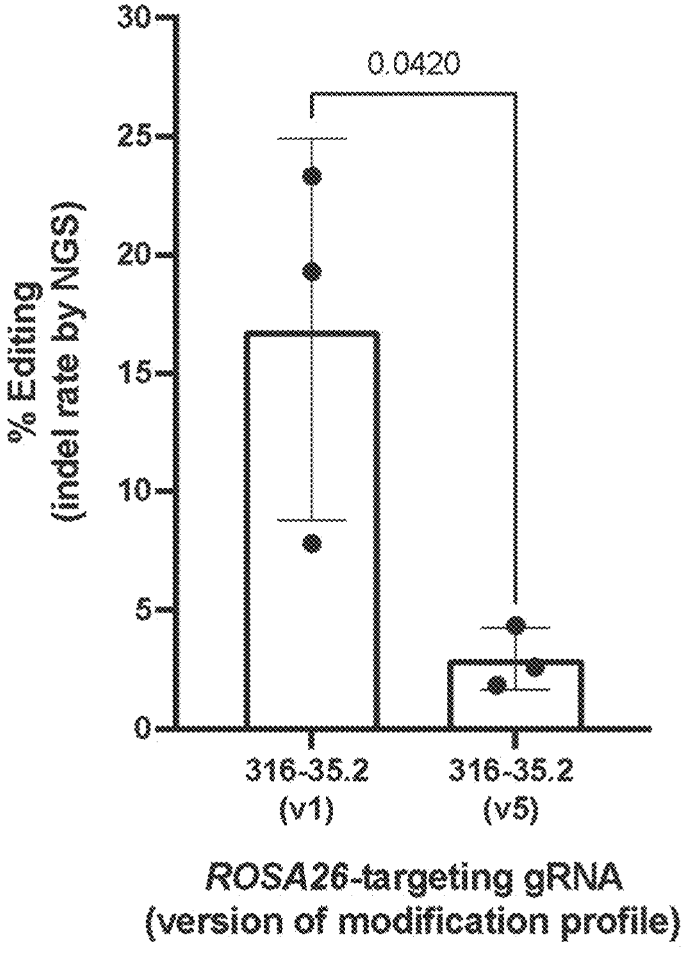
FIG. 22B is a plot illustrating the quantification of percent editing measured as indel rate detected by NGS at the ROSA26 locus in mice treated with LNPs formulated with CasX 676 mRNA #2 and the indicated chemically-modified ROSA26-targeting gRNA, as described in Example 7.

Delivery of LNPs Encapsulating CasX mRNA and Targeting gRNA In Vivo:

To assess the effects of using v1 and v5 of scaffold 316 in vivo, CasX 676 mRNA #2 (see Table 28) and a ROSA26-targeting gRNA using scaffold 316 with spacer 35.2 (v1 or v5; see Table 26) were encapsulated within the same LNP using a 1:1 mass ratio for mRNA:gRNA. Formulated LNPs were buffer-exchanged to PBS for in vivo injection. Briefly, LNPs were administered intravenously through the retro-orbit sinus into 4-week old C57BL/6 mice. Mice were observed for five minutes after injection to ensure recovery from anesthesia before being placed into their home cage. Naïve, uninjected animals served as experimental controls. Six days post-administration, mice were euthanized, and the liver tissue was harvested for gDNA extraction using the Zymo Research Quick DNA/RNA Miniprep™ kit following the manufacturer's instructions. Target amplicons were then amplified from the extracted gDNA with a set of primers targeting the mouse ROSA26 locus and processed using similar methods as described in Example 7 for editing assessment by NGS. The results of this experiment are shown in FIG. 22B.

Figure 23:
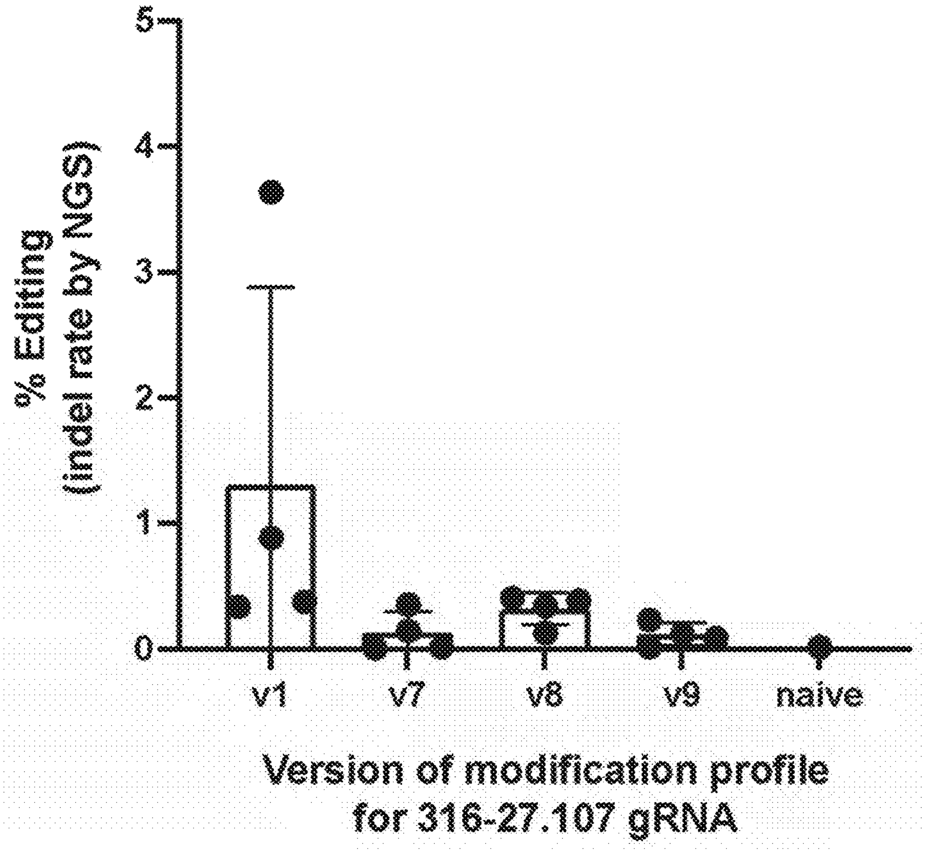
FIG. 23 is a bar graph showing the results of an editing assay measured as indel rate detected by NGS at the mouse PCSK9 locus in mice treated with LNPs formulated with CasX 676 mRNA #1 and the indicated chemically-modified PCSK9-targeting gRNA, as described in Example 7. Untreated mice served as experimental control.

To compare the effects of using v7, v8, and v9 of scaffold 316 on editing at the PCSK9 locus in vivo, CasX 676 mRNA #1 (see Table 29 for sequences) and a PCSK9-targeting gRNA using scaffold 316 with spacer 27.107 (v1, v7, v8, or v9; see Table 26), were encapsulated within the same LNP using a 1:1 mass ratio for mRNA:gRNA for each gRNA. LNPs were administered retro-orbitally into 6-week old C57BL/6 mice, as described above, and mice were euthanized seven days post-injection to harvest liver tissue for gDNA extraction for editing assessment by NGS at the PCSK9 locus. The results of this experiment are shown in FIG. 23.

TABLE 29

Encoding sequences of CasX 676 mRNA #1 molecule

| CasX ID | Component (ID) | Description | SEQ ID NO: |
|---|---|---|---|
| CasX 676 mRNA #1 | 5'UTR | hHBA | 3188 |
| | START codon + c-MYC NLS | | 3133 |
| | CasX 676 | | 3134 |
| | c-MYC NLS + STOP codons | | 3135 |
| | 3'UTR | hHBA | 3189 |
| | Poly(A) tail | | 3057 |

*Components are listed in a 5' to 3' order within the constructs

Results

Figure 16A:
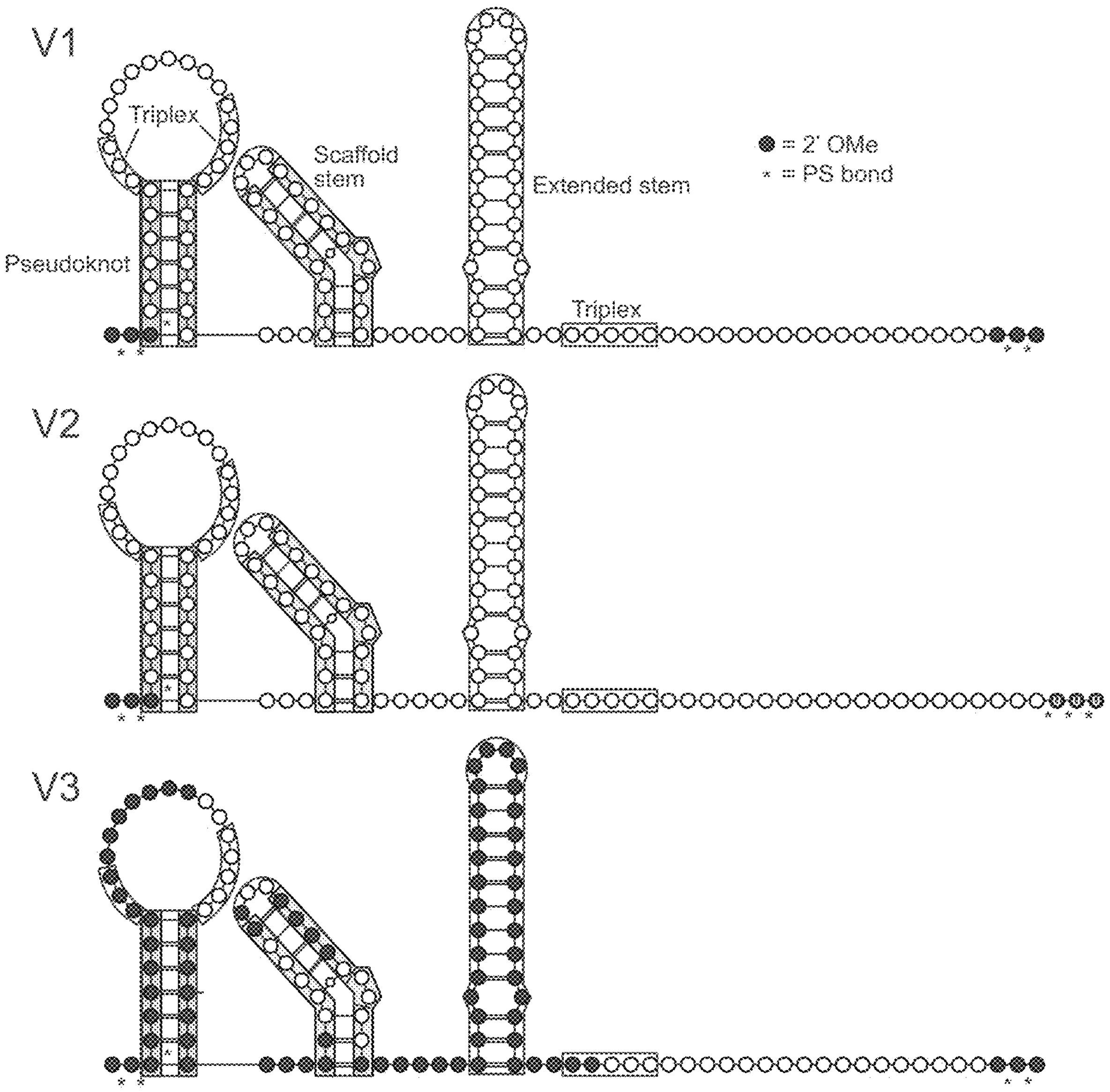
FIG. 16A is a schematic illustrating versions 1-3 of chemical modifications made to gRNA scaffold variant 235, as described in Example 7. Structural motifs are highlighted. Standard ribonucleotides are depicted as open circles, and 2'OMe-modified ribonucleotides are depicted as black circles. Phosphorothioate bonds are indicated with * below or beside the bond. For the v2 profile, the addition of three 3' uracils (3'UUU) is annotated with "U"s in the relevant circles.
Figure 16B:
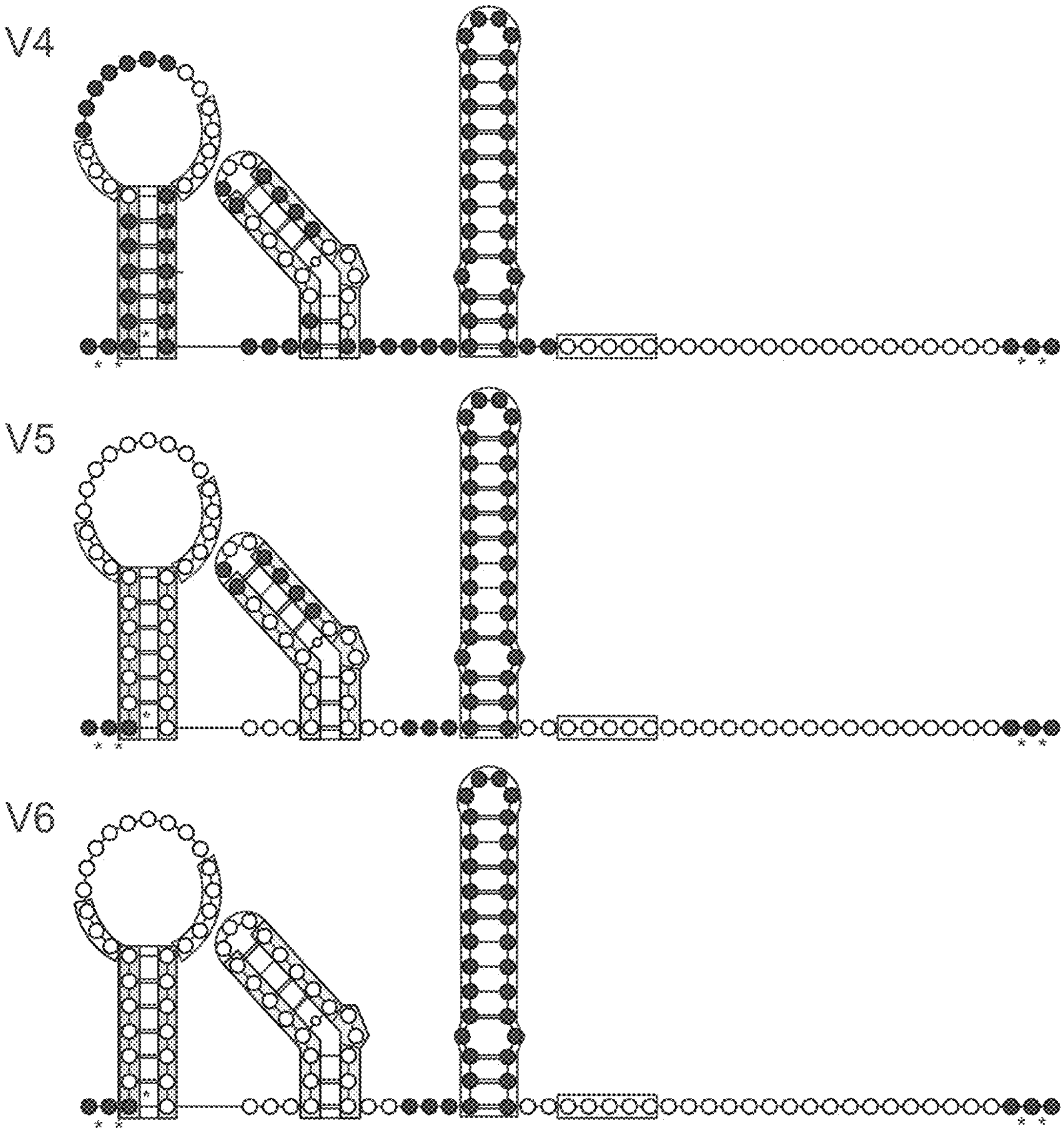
FIG. 16B is a schematic illustrating versions 4-6 of chemical modifications made to gRNA scaffold variant 235, as described in Example 7. Structural motifs are highlighted. Standard ribonucleotides are depicted as open circles, and 2'OMe-modified ribonucleotides are depicted as black circles. Phosphorothioate bonds are indicated with * below or beside the bond.

Assessing the Effects of Various Chemical Modifications on gRNA Activity:

Several studies involving Cas9 have demonstrated that chemical modifications of the gRNA resulted in significantly improved editing activity when delivered with Cas9 mRNA. Following delivery of Cas9 mRNA and gRNA into target cells, unprotected gRNA is susceptible to degradation during the mRNA translation process. Addition of chemical modifications such as 2'O-methyl (2'Ome) groups and phosphorothioate bonds can reduce the susceptibility of the gRNA to cellular Rnases, but also have the potential to disrupt folding of the gRNA and its interactions with the CRISPR-Cas protein. Given the lack of structural similarity between CasX and Cas9, as well as their respective gRNAs, appropriate chemical modification profiles must be designed and validated de novo. Using published structures of wild-type CasX from Deltaproteobacteria (PDB codes 6NY1, 6NY2, and 6NY3) as reference, residues that appeared potentially amenable to modification were selected. However, the published structures were of a wild type CasX ortholog and gRNA distinct from the species used as the basis for the engineered variants presented here, and they also lacked the resolution to confidently determine interactions between protein side-chains and the RNA backbone. These limitations introduced a significant amount of ambiguity into determining which nucleotides might be safely modified. As a result, six profiles of chemical modifications (denoted as versions) were designed for initial testing, and these six profiles are illustrated in FIGS. 16A and 16B. The v1 profile was designed as a simple end-protected structure, where the first and last three nucleotides were modified with 2'Ome and phosphorothioate bonds. In the v2 profile, 3'UUU tail was added to mimic the termination sequence used in cellular transcription systems and to move the modified nucleotides outside of the region of the spacer involved in target recognition. The v3 profile included the end protection as in v1, as well as the addition of 2'Ome modifications at all nucleotides identified to be potentially modifiable based on structural analysis. The v4 profile was modeled based on v3, but with all the modifications in the triplex region removed, as this structure was predicted to be more sensitive to any perturbation of the RNA helical structure and backbone flexibility. The v5 profile maintained chemical modifications in the scaffold stem and extended stem regions, while the v6 profile harbored modifications only in the extended stem. The extended stem is a region that would become fully exposed to solvent in the RNP and is amenable to replacement by other hairpin structures, and therefore presumably relatively insensitive to chemical modifications.

The minimally modified v1 gRNA was initially assessed against an unmodified gRNA (v0) to determine the potential benefit of such chemical modifications on editing when the gRNA was co-delivered with CasX mRNA to target cells. Modified (v1) and unmodified (v0) B2M-targeting gRNAs with spacer 7.37 were co-transfected with CasX mRNA into HepG2 cells, and editing at the B2M locus was measured by loss of surface presentation of the B2M-dependent HLA complex, as detected by flow cytometry (FIG. 17). The data demonstrate that use of the v1 gRNA resulted in substantially greater loss of B2M expression compared to the levels seen with v0 gRNA across the various doses, thereby confirming that end modifications of the gRNA increased CasX-mediated editing activity upon delivery of the CasX mRNA and gRNA.

The broader set of gRNA chemical modification profiles were assessed using PCSK9-targeting gRNAs using scaffold variant 235 and spacers 6.7 and 6.8 to determine whether the additional chemical modifications would be able to support the formation of active RNPs. In vitro cleavage assays described above were performed to determine $k_{cleave}$ and fraction competence for these engineered gRNAs harboring the various chemical modification profiles. The results from these in vitro cleavage assays are shown in Table 30. The data demonstrate that gRNAs with the v3 profiles exhibited no activity, an indication that the addition of some chemical modifications significantly interfered with RNP formation or activity. Adding v4 chemical modifications resulted in a reasonable cleavage rate in the excess RNP condition, but exhibited very low fraction competence. The difference between v3 and v4 modifications confirmed that modifications in the triplex region prevented the formation of any active RNP, either due to the inability of the gRNA to fold properly or a disruption in the gRNA-protein interactions. The reduced fraction competence resulting from appending v4 modifications suggest that while the gRNA was able to successfully assemble with the CasX protein to form a cleavage-competent RNP, a large majority of the gRNA was misfolded, or that the appended chemical modifications reduced the affinity of the gRNA for the CasX protein and impeded the efficiency of RNP formation. Application of the v5 or v6 profiles resulted in competent fractions that were comparable to, but slightly lower than, those obtained for reactions using the v1 and v2 modifications. While the $k_{cleave}$ values were relatively consistent between v5 and v6 gRNAs, both v5 and v6 gRNAs achieved nearly half of the $k_{cleave}$ values for v1 and v2 gRNAs. The reduced $k_{cleave}$ value for v6 gRNA was particularly surprising, given the lack of expected interaction between the gRNA and CasX protein in the modified extended stem. However, for both v5 and v6 gRNAs, it is possible that the reduced flexibility of the gRNA, resulting from the 2'Ome modifications, inhibited structural changes in the RNP required for efficient cleavage, or that the modified initial base-pairs of the hairpin involved in CasX protein interaction had been negatively impacted by the inclusion of the 2'Ome groups.

TABLE 30

Parameters of cleavage activity assessed for CasX RNPs with the various PCSK9-targeting gRNAs using scaffold 235 and harboring the indicated chemical modification profile, denoted by version number.

| gRNA (scaffold variant-spacer, version no.) | $K_{cleave}$ (min$^{-1}$) | Fraction competence |
|---|---|---|
| 235-6.7, v1 | 0.901 | 0.398 |
| 235-6.8, v1 | 1.36 | 0.398 |
| 235-6.7, v2 | 0.454 | 0.386 |
| 235-6.8, v2 | 2.03 | 0.361 |
| 235-6.7, v3 | 0 | 0 |
| 235-6.8, v3 | 0 | 0 |
| 235-6.7, v4 | 0.434 | 0.031 |
| 235-6.8, v4 | 0.257 | 0.005 |
| 235-6.7, v5 | 0.506 | 0.313 |
| 235-6.8, v5 | 0.680 | 0.388 |
| 235-6.7, v6 | 0.462 | 0.346 |
| 235-6.8, v6 | 0.715 | 0.325 |

The chemically-modified PCSK9-targeting gRNAs based on scaffold 235 were subsequently assessed for editing in a cell-based assay. CasX mRNA and chemically modified PCSK9-targeting gRNAs were co-transfected into HepG2 cells using Lipofectamine™. Editing levels were measured by indel rate at the PCSK9 locus by NGS and secreted PCSK9 levels by ELISA, and the data are displayed in Table 31. The data demonstrate that use of v3 and v4 gRNAs resulted in minimal editing activity at the PCSK9 locus, consistent with findings from the biochemical in vitro cleavage assays shown in Table 30. Meanwhile, use of v5 and v6 gRNAs resulted in editing levels, measured by indel rate and PCSK9 secretion, that were slightly lower than the levels attained with use of v1 and v2 gRNAs (Table 31). Specifically, the results show that use of v1 and v2 gRNAs, which harbored end modifications, resulted in ~80-85% editing at the PCSK9 locus, indicating that adding chemical modifications to the gRNA ends was sufficient to achieve efficient editing with CasX. While the data demonstrate that use of v5 and v6 gRNAs resulted in efficient editing in vitro, near-saturating levels of editing were observed with use of the v1 gRNA in this experiment where a single dose of the gRNA was transfected. As a result, the use of a single dose rendered it challenging to assess clearly the effects of the chemical modifications on editing under guide-limiting conditions. Therefore, profiles v1 and v5 were chosen for further testing, as v1 contains the simplest modification profile, and v5 is the most heavily modified profile whose application demonstrated robust activity in vitro (Tables 30 and 31).

TABLE 31

Editing levels measured by indel rate at PCSK9 locus by NGS and secreted PCSK9 levels by ELISA in HepG2 cells co-transfected with CasX 491 mRNA and various chemically-modified PCSK9-targeting gRNAs using scaffold 235 and either spacer 6.7 or 6.8.

| Experimental | Indel rate (edit fraction) | | Secreted PCSK9 (ng/ml) | |
|---|---|---|---|---|
| condition | Mean | Stdev | Mean | Stdev |
| CasX mRNA only | 0.0021 | 0.003 | 52 | 14 |
| 235-6.7, v1 | 0.83 | 0.0058 | 18 | 5.7 |
| 235-6.7, v2 | 0.79 | 0.0071 | 21 | 4 |
| 235-6.7, v3 | 0.024 | 0.02 | 48 | 19 |
| 235-6.7, v4 | 0.12 | 0.006 | 34 | 5.5 |
| 235-6.7, v5 | 0.73 | 0.023 | 21 | 9 |
| 235-6.7, v6 | 0.75 | 0.0069 | 22 | 8.8 |

TABLE 31-continued

Editing levels measured by indel rate at PCSK9 locus by NGS and secreted PCSK9 levels by ELISA in HepG2 cells co-transfected with CasX 491 mRNA and various chemically-modified PCSK9-targeting gRNAs using scaffold 235 and either spacer 6.7 or 6.8.

| Experimental | Indel rate (edit fraction) | | Secreted PCSK9 (ng/ml) | |
|---|---|---|---|---|
| condition | Mean | Stdev | Mean | Stdev |
| 235-6.8, v1 | 0.85 | 0.017 | 16 | 4.4 |
| 235-6.8, v2 | 0.83 | 0.0028 | 20 | 1.5 |
| 235-6.8, v3 | 0.023 | 0.0027 | 39 | 2.7 |
| 235-6.8, v4 | 0.088 | 0.0086 | 42 | 10 |
| 235-6.8, v5 | 0.77 | 0.017 | 19 | 1.6 |
| 235-6.8, v6 | 0.78 | 0.014 | 24 | 6.9 |
| Non-targeting ctrl | 0.0019 | 0.0026 | 42 | 12 |

The v1 and v5 profiles were further tested in another cell-based assay to assess their effects on editing efficiency. LNPs were formulated to co-encapsulate CasX 676 mRNA #2 and v1 and v5 chemically-modified ROSA26-targeting gRNAs using the newly-designed gRNA scaffold 316 (described further in the following sub-section). The "v5" profile was modified slightly for application to the 316 scaffold. Three 2' Ome modifications in the non-base-paired region immediately 5' of the extended stem were removed to restrict modifications to the two stemloop regions. Hepa1-6 hepatocytes were treated with the resulting LNPs at various doses and harvested eight days post-treatment to assess editing at the ROSA26 locus, measured as indel rate detected by NGS (FIG. 22A). The data demonstrate that treatment with LNPs delivering the v5 ROSA26-targeting gRNA resulted in markedly lower editing levels across the range of doses compared to the levels achieved with the v1 counterpart (FIG. 22A). There are several possible explanations for the differences in relative activity observed with use of v5 gRNA in FIG. 22A relative to that observed in Table 31. The first and most likely possible explanation is that the single dose used to achieve editing shown in Table 31 was too high to measure differences in activity accurately between use of v5 gRNA and v1 gRNA. It is also possible that the removal of the modifications outside the stemloop motifs in the 316 version of v5 negatively impacted guide activity. While it is possible that these modifications provide stability benefits that outweigh an activity cost imparted by the stemloop modifications, this seems unlikely given that increasing levels of modification have so far resulted in decreased activity. A final possible explanation is that the modifications in the v5 profile might negatively impact LNP formulation or behavior through differential interactions between the modified nucleotide backbone and the ionizable lipid of the LNP, potentially resulting in less efficient gRNA encapsulation or in less efficient gRNA release following internalization.

LNPs co-encapsulating the CasX mRNA #2 and v1 and v5 chemically-modified ROSA26-targeting gRNAs based on scaffold 316 were further tested in vivo. FIG. 22B shows the results of the editing assay as percent editing measured as indel rate at the ROSA26 locus. The data demonstrate that use of the v5 gRNA resulted in ~5-fold lower editing compared to that achieved with use of the v1 gRNA, under more relevant testing conditions of in vivo LNP delivery. These findings support the reduced cleavage rate observed biochemically for the v5 gRNA in Table 30, an indication that the v5 modifications have interfered with some aspect of CasX activity. Given the consistent decrease in activity detected in v5 and v6 profiles (Table 30), the reduced editing may be attributed to modifications in the extended stem region. Although the extended stem of the gRNA has minimal interactions with the CasX protein, it is possible that addition of 2'Ome groups at the first base-pair disrupted either the CasX protein-gRNA interactions or the complex RNA fold where the extended stem meets the pseudoknot and triplex regions. More specifically, inclusion of the 2'Ome groups might have adversely affected the basal base-pairs of the gRNA extended stem and residues R49, K50, and K51 of the CasX protein. Finally, structural studies of CasX have suggested that flexibility of the gRNA is required for efficient DNA cleavage (Liu J, et al, CasX enzymes comprise a distinct family of RNA-guided genome editors. *Nature* 566:218-223 (2019); Tsuchida C A, et al, Chimeric CRISPR-CasX enzymes and guide RNAs for improved genome editing activity. *Mol Cell* 82(6): 1199-1209 (2022)). Thus, the addition of the 2'Ome groups throughout the extended stem might have enforced a more rigid A-form helical structure and prevented the needed flexibility for the gRNA for efficient cleavage. Furthermore, it is possible that the additional modifications in the scaffold stem in the v5 and v6 profiles might be detrimental to activity, though this is currently unclear given the limited comparisons between the v5 and v6 profiles.

Figure 18:
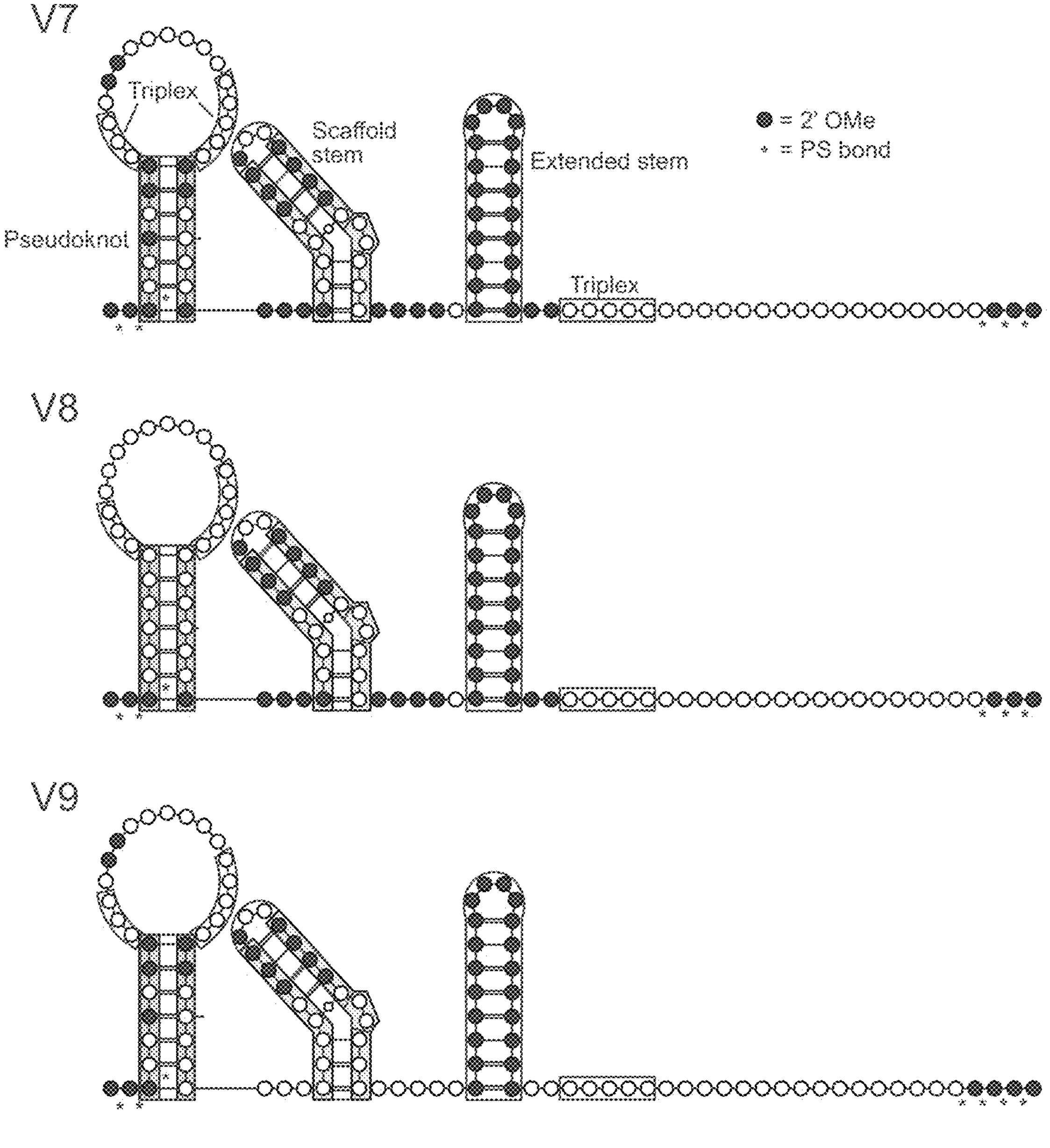
FIG. 18 is a schematic illustrating versions 7-9 of chemical modifications made to gRNA scaffold variant 316, as described in Example 7. Structural motifs are highlighted. Standard ribonucleotides are depicted as open circles, and 2'OMe-modified ribonucleotides are depicted as black circles. Phosphorothioate bonds are indicated with * below or beside the bond.

Additional modification profiles were designed with the goal of enhancing gRNA stability while mitigating the adverse effects on RNP cleavage activity. Using recently published structures of wild-type CasX from Planctomycetes (PDB codes 7WAY, 7WAZ, 7WB0, 7WB1), which has a higher homology to the engineered CasX variants being assessed, additional chemical modification profiles for gRNAs were designed and are illustrated in FIG. 18. These profiles illustrate the addition of 2'Ome groups and phosphorothioate bonds to a newly-designed gRNA scaffold variant, which is described in the ensuing sub-section. These new gRNA chemical modification profiles were designed based on the initial data demonstrating sufficient editing activity observed in Table 31 with use of the v5 gRNA that suggested that modifications to the extended stem and scaffold stem regions would not negatively impact activity. The v7 profile was designed to include 2'Ome at residues likely to be modifiable throughout the gRNA structure, which excluded the triplex region, given the dramatic negative effects of adding such modifications observed earlier with the v3 profile. More conservative profiles, v8 and v9, were also designed, as illustrated in FIG. 18. For the v8 construct, modifications were removed in the pseudoknot and triplex loop region, but were retained in the scaffold stem, extended stem, and their flanking single-stranded regions, in addition to the 5' and 3' termini. For the v9 profile, modifications were removed in the single-stranded regions flanking the stemloops, but were retained in the stemloops themselves, in addition to the pseudoknot, triplex loop, and 5' and 3' termini. The additional chemical modification profiles v7, v8, and v9 of the newly designed gRNA scaffold variant 316 (discussed further below) were assessed in vivo at the PCSK9 locus. The results of the editing assay in vivo quantified as percent editing at the PCSK9 locus measured as indel rate as detected NGS are illustrated in FIG. 23. Despite the fact that low editing efficiency was detected overall, the data demonstrate that use of v7, v8, and v9 gRNAs resulted in lower editing levels at the PCSK9 locus compared to the indel rate achieved with use of the v1 gRNA (FIG. 23). Given the findings in FIGS. 22A-22B showing inferior editing activity attained with the v5 gRNA, it is unsurprising that v7, v8, and v9 profiles similarly demonstrated comparatively lower editing activity. As illustrated in FIG. 18, the v7, v8, and v9 profiles include modifications throughout the extended stem region, which might have interfered with RNP activity.

Comparison of gRNA Scaffold Variant 174 and 316 Using an In Vitro Cleavage Assay:

Previous work had established gRNA scaffold variant 235 as a top-performing scaffold variant across multiple delivery conditions. However, the longer length of scaffold 235 (119 bp, when using a 20 bp spacer) relative to gRNAs including scaffold 174 (109 bp, when using a 20 bp spacer) increased the difficulty of solid-phase RNA synthesis, which would result in increased manufacturing costs, decreased purity and yield, and higher rates of synthesis failures. To address these issues but retain the improved activity of using scaffold variant 235, a chimeric gRNA scaffold was designed primarily on the basis of the scaffold 235 sequence, but the extended stemloop of scaffold 235 was replaced with the shorter extended stemloop of scaffold variant 174 (FIGS. 19A-19C). The resulting chimeric scaffold, named scaffold 316, was synthesized in parallel with scaffold 174 and PCSK9-targeting spacers 6.7 and 6.8, and B2M-targeting spacer 7.9 harboring the v1 chemical modification profile, with 2'OMe and phosphorothioate bonds on the first and last three nucleotides of all gRNAs (see Table 26). Scaffold variant 174 was chosen as the comparator rather than variant 235 because variant 174 was the best previously characterized scaffold with the same length as variant 316.

In vitro cleavage activity was assessed for gRNAs with scaffold 174 and 316 and spacers 6.7 and 6.8. Cleavage assays were carried out with 20-fold excess RNP over a matching dsDNA target. Cleavage rates were quantified for all four guides, and the results are shown in Table 32. The data demonstrate that in the context of spacer 6.7, use of either scaffold 174 or 316 resulted in similar cleavage rates, with scaffold 316 resulting in marginally faster cleavage than that achieved with scaffold 174. In the context of spacer 6.8, the difference in cleavage activity was more pronounced: CasX RNPs using scaffold 316 were able to cleave DNA nearly twice as quickly as CasX RNPs using scaffold 174 (Table 32).

Assays were also performed with equimolar amounts of RNP and DNA target over a longer time course to assess the fraction of expected RNP active for cleavage. As the CasX RNP is essentially single-turnover over the tested timescale, and the concentrations used are expected to be substantially higher than the $K_D$ of the DNA-binding reaction, the amount of cleaved DNA should approximate the amount of active RNP. For either spacer 6.7 or 6.8, the active fraction of CasX RNPs incorporating scaffold 316 was 25-30% higher than for CasX RNPs using scaffold 174 (Table 32). These data suggest that a higher fraction of gRNA using scaffold 316 was properly folded for association with the CasX protein, or that the gRNA using scaffold 316 was able to associate more strongly with the CasX protein. Compared to scaffold 174, scaffold 316 harbors mutations expected to stabilize the pseudoknot and triplex structures required for proper gRNA folding. The increased stability of these motifs in particular, which were more likely to misfold than the simple hairpins found elsewhere in the gRNA structure, might result in a slightly higher fraction of the gRNAs folding into an active conformation.

TABLE 32

Parameters of cleavage activity assessed for CasX RNPs with gRNAs containing scaffold variant 174 or 316 with the version 1 (v1) chemical modification profile.

| gRNA (scaffold variant-spacer) | $k_{cleave}$ ($min^{-1}$) | Fraction competence |
|---|---|---|
| 174-6.7, v1 | 0.236 | 0.194 |
| 174-6.8, v1 | 0.142 | 0.165 |
| 316-6.7, v1 | 0.264 | 0.244 |
| 316-6.8, v1 | 0.272 | 0.213 |

Comparison of gRNA Scaffold Variant 174 and 316 in a Cell-Based Assay:

An editing assessment using gRNA scaffold variant 174 compared to variant 316 was performed in a cell-based assay. CasX 491 mRNA and the version 1 (v1) of PCSK9-targeting gRNAs using spacers 6.7 and 6.8 were lipofected into HepG2 cells. Treated cells were harvested 28 hours post-transfection for analysis of editing levels at the PCSK9 locus by NGS and secreted PCSK9 levels by ELISA, and the data are presented in FIG. 20. The data demonstrate that use of any of the PCSK9-targeting gRNA tested resulted in efficient editing at the PCSK9 locus and substantial reduction in PCSK9 secretion compared to the non-targeting control using the B2M-targeting gRNA. The results also show that use of scaffold 316 resulted in more effective editing at the PCSK9 locus than that observed with use of scaffold 174 (~10 percentage point increase in editing rate achieved with scaffold 316 over scaffold 174). This finding is further supported by the ELISA results, such that use of scaffold 316 resulted in more effective reduction of PCSK9 secretion compared to that achieved with use of scaffold 174.

Scaffold variants 174 and 316 were also assessed in an editing assay where LNPs were formulated to co-encapsulate CasX 491 mRNA and B2M-targeting gRNA harboring either scaffold variant. HepG2 cells were treated with the resulting LNPs at various doses and harvested seven days post-treatment to assess editing at the B2M locus, measured as indel rate detected by NGS (FIG. 21A) and loss of surface presentation of the B2M-dependent HLA complex, as detected by flow cytometry (FIG. 21B). The results from both assays demonstrate that treatment with LNPs to deliver the B2M-targeting gRNA using scaffold 316 resulted in higher editing potency at the B2M locus compared to LNPs delivering the gRNA using scaffold 174 at each dose (FIGS. 21A and 21B). Specifically, at the highest dose of 250 ng, use of scaffold 316 resulted in an editing level that was nearly two-fold higher than the level attained with using scaffold 174. This substantial increase in editing efficacy when using scaffold 316 versus scaffold 174, compared to the comparatively modest difference in activity observed from the in vitro cleavage assays, might be attributed to the destabilization of gRNA structure and folding during LNP formulation. The low pH conditions and association of cationic lipids during LNP formulation could adversely affect parts of the gRNA structure and result in unfolding. Consequently, it would be necessary for the gRNA to refold quickly in the cytoplasm upon delivery, both to bind the CasX protein to form the RNP and to evade Rnase degradation. The stability-increasing mutations in scaffold 316 compared to scaffold 174 might provide a substantial benefit in supporting proper gRNA refolding in the cytoplasm after LNP delivery, while the deliberate folding protocol carried out for the gRNA prior to biochemical experiments likely reduced the impact of these mutations.

Example 8: Demonstration that Altering the UTR Sequences of the Engineered CasX mRNA can Affect CasX-Mediated Editing 5' and 3'UTRs are essential and required for efficient translation of mRNA. Here, experiments were performed to demonstrate that altering the 5' and 3' UTR sequences of the engineered CasX mRNA affects CasX-mediated editing at a target locus when CasX mRNA and targeting gRNAs were delivered in vitro via transfection.

Materials and Methods

IVT of CasX mRNA:

CasX 676 mRNA was generated by IVT. Briefly, constructs encoding for a 5'UTR region, a codon-optimized CasX 676 with flanking c-MYC NLSes, and a 3'UTR region were cloned into a plasmid containing a T7 promoter and 80-nucleotide poly(A) tail. The resulting plasmid was linearized prior to use for IVT reactions, which were carried out with CleanCap® AG and N1-methyl-pseudouridine. For the 5' cap, the CleanCap® AG contains a m7G(5')ppp(5') mAG structure, where "m7G" denotes N7-methylguanosine, "mA" denotes 2'O-methyladenosine, and (5')ppp(5') denotes a 5' to 5' triphosphate bridge. An extra guanine nucleotide was incorporated following the CleanCap® AG to enhance transcription initiation, resulting in the incorporation of m7G(5')ppp(5')mAGG as the full 5' cap structure. As discussed below in Example 9, the substitution of the uridine ribonucleoside to N1-methyl-pseudouridine improves mRNA performance and reduces mRNA immunogenicity.

IVT reactions were subsequently subjected to Dnase digestion to remove template DNA and purification using an oligo-dT column. In this example, two configurations of CasX 676 mRNAs were generated for assessment in vitro. The encoding sequences of the two CasX mRNA configurations are detailed in Table 33. Full-length RNA sequences encoding the CasX mRNA with the chemical modifications are listed in Table 34.

TABLE 33

Encoding sequences of the two CasX mRNA molecules assessed in this example*.

| CasX mRNA ID | Component (ID) | Description | DNA sequence or SEQ ID NO: |
|---|---|---|---|
| CasX 676 mRNA #1 | 5'UTR | Human HBA | 3188 |
| | START codon + c-MYC NLS | | 3133 |
| | CasX 676 | | 3134 |
| | c-MYC NLS + STOP codons | | 3135 |
| | 3'UTR | Human HBA | 3189 |
| | Poly(A) tail | | 3057 |
| CasX 676 mRNA #2 | 5'UTR | Synthetic (TriLink) | 3047 |
| | START codon + c-MYC NLS | | 3133 |
| | CasX 676 | | 3134 |
| | c-MYC NLS + STOP codons | | 3135 |
| | 3'UTR | Mouse HBA | 3055 |
| | XbaI restriction site | | TCTAG |
| | (partial) Poly(A) tail | | 3057 |

*Components are listed in a 5' to 3' order within the constructs

TABLE 34

Full-length RNA sequences of CasX mRNA molecules assessed in this example. The 5' cap (m7G(5')ppp(5')mAG), discussed in the example herein, is not shown in the table. Modification 'mψ' = N1-methyl-pseudouridine

| CasX mRNA | SEQ ID NO | RNA Sequence |
|---|---|---|
| CasX 676 mRNA #1 | 3190 | ACmψCmψmψCmψGGmψCCCC<br>ACAGACmψCAGAGAGAACCC<br>GCCACCAmψGGCCCCmψGCm<br>ψGCCAAGAGAGmψGAAGCmψ<br>GGAmψAGCAGACAGGAGAmψ<br>CAAGCGGAmψmψAAmψAAAA<br>mψmψCGGAGAAGACmψGGmψ<br>GAAGGAmψmψCmψAACACAA<br>AGAAGGCmψGGCAAGACACG<br>GGGCCCmψAmψGAAGACACm<br>ψGCmψGGmψGAGAGmψGAmψ<br>GACACCCGACCmψGAGAGAA<br>AGACmψGGAAAACCmψGAGA<br>AAGAAGCCmψGAGAAmψAmψ<br>CCCCCAGCCCAmψCAGCAAC<br>ACAAGCCGGGCCAACCmψGA<br>AmψAAGCmψGCmψGACCGAC<br>mψACACCGAAAmψGAAGAAG<br>GCCAmψCCmψGCACGmψGmψ<br>AmψmψGGGAAGAGmψmψCCA<br>GAAAGACCCAGmψCGGCCmψ<br>GAmψGAGCAGAGmψGGCmψC<br>AGCCmψGCCAGCAAGAAGAm<br>ψCGAmψCAGAACAAGCmψGA<br>AGCCCGAAAmψGGACGAGAA<br>GGGGAACCmψGACAACCGCC<br>GGCmψmψmψGCCmψGmψAGC<br>CAGmψGCGGCCAGCCCCmψG<br>mψmψmψGmψGmψACAAACmψ<br>GGAACAGGmψGAGCGAAAAG<br>GGCAAGGCmψmψACACGAAm<br>ψmψACmψmψCGGCAGAmψGC<br>AACGmψGGCCGAGCACGAGA<br>AGCmψGAmψCAAGCmψGGCC<br>CAGCmψGAAGCCmψGAGAAG<br>GAmψAGCGAmψGAGGCAGmψ<br>GACAmψAmψmψCCCmψGGGC<br>AAGmψmψCGGACAGCGGGCC |

TABLE 34-continued

Full-length RNA sequences of CasX mRNA molecules assessed in this example. The 5' cap (m7G(5')ppp(5')mAG), discussed in the example herein, is not shown in the table. Modification 'mψ' = N1-methyl-pseudouridine

| CasX mRNA | SEQ ID NO | RNA Sequence |
|---|---|---|
| | | CmψGGAmψmψmψmψmψAmψm<br>ψCCAmψmψCAmψGmψGACCA<br>AGGAAmψCCACCCACCCCGm<br>ψCAAGCCmψCmψmψGCCCAA<br>AmψmψGCCGGCAACAGAmψA<br>CGCCmψCCAGCCCCGmψGGG<br>CAAGGCCCmψGAGCGACGCC<br>mψGmψAmψGGGCACCAmψCG<br>CCAGCmψmψCCmψGmψCmψA<br>AGmψACCAGGACAmψmψAmψ<br>CAmψCGAGCACCAGAAGGmψ<br>GGmψGAAGGGCAACCAGAAG<br>AGACmψGGAGAGCCmψGCGC<br>GAGCmψGGCCGGCAAGGAAA<br>ACCmψGGAGmψAmψCCmψAG<br>CGmψGACCCmψGCCmψCCmψ<br>CAGCCmψCAmψACAAAGGAG<br>GGCGmψGGAmψGCCmψACAA<br>CGAAGmψGAmψCGCCCGGGm<br>ψGCGGAmψGmψGGGmψGAAC<br>CmψGAAmψCmψGmψGGCAGA<br>AGCmψGAAGCmψGmψCmψAG<br>AGACGACGCCAAGCCCCmψG<br>CmψGAGACmψGAAGGGCmψm<br>ψCCCCAGCmψmψCCCmψCmψ<br>GGmψGGAGAGACAGGCAAAm<br>ψGAAGmψGGACmψGGmψGGG<br>ACAmψGGmψGmψGmψAACGm<br>ψGAAGAAGCmψGAmψCAAmψ<br>GAGAAGAAGGAGGACGGCAA<br>AGmψGmψmψCmψGGCAGAAm<br>ψCmψGGCCGGCmψACAAGCG<br>mψCAGGAGGCCCmψGCGGCC<br>CmψACCmψGAGCAGCGAGGA<br>AGACAGAAAGAAGGGCAAGA<br>AGmψmψCGCCCGGmψAmψCA<br>GCmψGGGGGACCmψGCmψGC<br>mψGCACCCmψCGAGAAGAAGC<br>ACGGCGAAGACmψGGGGGAA<br>GGmψGmψACGAmψGAGGCCm<br>ψGGGAGCGGAmψCGAmψAAG<br>AAGGmψGGAGGGCCmψGAGC<br>AAGCACAmψCAAGCmψGGAG<br>GAGGAACGGAGAmψCmψGAG<br>GACGCCCAGAGCAAGGCCGC<br>CCmψGACCGACmψGGCmψGA<br>GAGCCAAGGCCAGCmψmψCG<br>mψCAmψCGAGGGGCmψGAAG<br>GAGGCCGACAAGGACGAGmψ<br>mψCmψGCCGGmψGCGAACmψ<br>GAAGCmψGCAGAAGmψGGmψ<br>ACGGAGAmψCmψGAGAGGCA<br>AACCmψmψmψCGCCAmψCGA<br>GGCCGAGAACAGCAmψCCmψ<br>GGACAmψCAGCGGCmψmψCA<br>GCAAGCAGmψACAACmψGCG<br>CCmψmψmψAmψmψmψGGCAG<br>AAGGACGGAGmψGAAGAAGC<br>mψGAACCmψGmψACCmψGAm<br>ψCAmψCAACmψAmψmψmψCA<br>AGGGCGGCAAGCmψGAGAmψ<br>mψCAAGAAGAmψCAAGCCmψ<br>GAAGCCmψmψCGAGGCCAAC<br>AGAmψCmψACACCGmψGAmψ<br>mψmψAACAAGAAAAGCGGAG<br>AGAmψCGmψGCCAAmψGGAA<br>GmψGAACmψmψXAAXmψmψC<br>GACGACCCmψAACCmψGAmψ<br>CAmψCCmψGCCCCmψGGCAm<br>ψmψmψGGCAAGCGGCAGGGC |

TABLE 34-continued

Full-length RNA sequences of CasX mRNA molecules assessed in this example. The 5' cap (m7G(5')ppp(5')mAG), discussed in the example herein, is not shown in the table. Modification 'mψ' = N1-methyl-pseudouridine

| CasX mRNA | SEQ ID NO | RNA Sequence |
|---|---|---|
| | | AGAGAGmψmψCAmψCmψGGA<br>ACGACCmψGCmψGmψCmψCm<br>ψGGAGACCGGCAGCCmψGAA<br>GCmψGGCCAACGGCAGAGmψ<br>GAmψCGAGAAGACACmψGmψ<br>ACAACAGACGAACCAGACAA<br>GACGAGCCCGCCCmψGmψmψ<br>mψGmψGGCCCmψGACCmψmψ<br>CGAGAGAAGAGAGGmψGCmψ<br>GGACAGCAGCAAmψAmψCAA<br>GCCmψAmψGAACCmψGAmψC<br>GGCGmψGGACCGGGGCGAGA<br>ACAmψCCCmψGCCGmψGAmψ<br>CGCCCmψmψACCGACCCCGA<br>GGGAmψGCCCmψCmψGAGCC<br>GGmψmψmψAAAGACAGCCmψ<br>GGGCAACCCmψACCCACAmψ<br>CCmψGAGAAmψmψGGCGAGm<br>ψCCmψACAAGGAGAAGCAGA<br>GAACCAmψCCAGGCCAAGAA<br>GGAGGmψGGAGCAGCGGCGG<br>GCmψGGCGGCmψACmψCCCG<br>GAAGmψACGCCAGCAAGGCC<br>AAGAACCmψGGCCGACGACA<br>mψGGmψmψAGAAAmψACCGC<br>CAGAGACCmψCCmψGmψACm<br>ψACGCmψGmψGACCCAGGAC<br>GCCAmψGCmψGAmψCmψmψC<br>GAGAACCmψGAGCAGAGGCm<br>ψmψCGGCAGACAGGGCAAGA<br>GAACCmψmψCAmψGGCCGAG<br>AGACAGmψACACCCGGAmψG<br>GAGGACmψGGCmψGACCGCC<br>AAGCmψGGCCmψACGAGGGC<br>CmψGCCCmψCmψAAGACCmψ<br>ACCmψGmψCCAAGACCmψmψ<br>GGCACAGmψACACCAGCAAG<br>ACAmψGCmψCmψAACmψGCG<br>GCmψmψCACAAmψCACGAGC<br>GCCGACmψACGACCGGGmψG<br>CmψGGAGAAACmψGAAGAAG<br>ACCGCCACAGGCmψGGAmψG<br>ACCACCAmψmψAACGGCAAG<br>GAGCmψGAAGGmψGGAGGGC<br>CAGAmψCACCmψACmψACAA<br>CAGGmψACAAACGGCAGAAC<br>GmψGGmψGAAGGACCmψGAG<br>CGmψGGAACmψGGAmψAGAC<br>mψGAGCGAGGAAAGCGmψAA<br>ACAAmψGACAmψCAGCAGCm<br>ψGGACCAAGGGCCGGAGCGG<br>CGAGGCCCmψGAGCCmψGCm<br>ψGAAGAAGAGAmψmψCmψCC<br>CACAGACCAGmψGCAGGAGA<br>AGmψmψCGmψGmψGmψCmψG<br>AACmψGCGGCmψmψCGAGAC<br>CCACGCCGACGAGCAAGCCG<br>CCCmψGAACAmψCGCCCGGm<br>ψCmψmψGGCmψmψmψmψCCm<br>ψGCGGAGCCAGGAGmψACAA<br>GAAGmψACCAGACAAACAAG<br>ACCACAGGCAACACAGACAA<br>GAGAGCCmψmψCGmψCGAGA<br>CCmψGGCAGAGCmψmψCmψA<br>CAGAAAGAAGCmψGAAGGAG<br>GmψGmψGGAAGCCmψGCCGm<br>ΨGGGAAGCCCCGCmψGCCAA<br>GAGAGmψGAAGCmψGGACmψ<br>AAmψAGAmψAAGCmψGGAGC<br>CmψCGGmψGGCCAmψGCmψm |

TABLE 34-continued

Full-length RNA sequences of CasX mRNA molecules assessed in this example. The 5' cap (m7G(5')ppp(5')mAG), discussed in the example herein, is not shown in the table. Modification 'mψ' = N1-methyl-pseudouridine

| CasX mRNA | SEQ ID NO | RNA Sequence |
|---|---|---|
| | | ψCmψmψGCCCCmψmψGGGCC mψCCCCCCAGCCCCmψCCmψ CCCCmψmψCCmψGCACCCGm ψACCCCCGmψGGmψCmψmψm ψGAAmψAAAGmψCmψGAGmψ GGGCGGCAAAAAAAAAAAAA AAAAAAAAAAAAAAAAAAAA AAAAAAAAAAAAAAAAAAAA AAAAAAAAAAAAAAAAAAAA AAAAAAA |
| CasX 676 mRNA #2 | 3136 | See Table 22 for sequence |

Synthesis of gRNAs:

In this example, gRNAs targeting the mouse PCSK9 locus were designed using gRNA scaffold 174 with a v1 modification profile (see Example 7) and chemically synthesized. The sequences of the PCSK9-targeting spacers are listed in Table 35.

TABLE 35

Sequences of spacers targeting the mouse PCSK9 locus assayed in this example

| Spacer ID | Target | RNA sequence | SEQ ID NO: |
|---|---|---|---|
| 27.103 | mouse PCSK9 | UAAUCUCCAUCCUCGUCCUG | 3073 |
| 27.105 | mouse PCSK9 | CCAAGAAGCCAGGGAAGAGG | 3192 |
| 27.106 | mouse PCSK9 | ACAUAUCUUUUAUGACCUCU | 3193 |
| 27.107 | mouse PCSK9 | CUGGCUUCUUGGUGAAGAUG | 3194 |
| 27.108 | mouse PCSK9 | UGGUGAAGAUGAGCAGUGAC | 3195 |
| 27.116 | mouse PCSK9 | GCCGUUGCUCCAAGGUAUGG | 3196 |
| 27.117 | mouse PCSK9 | UUCUUGGGGAUCAGGAGGCC | 3197 |

Transfection of CasX mRNA and gRNA into Mouse Hepa1-6 Cells In Vitro:

Editing at the mouse PCSK9 locus was assessed by delivering in vitro transcribed CasX mRNA (CasX mRNA #1 or CasX mRNA #2; see Table 33) and synthesized gRNAs targeting PCSK9 into Hepa1-6 cells via transfection. Briefly, each well of 20,000 Hepa1-6 cells were lipofected with in vitro transcribed mRNA coding for CasX 676 and a PCSK9-targeting gRNA. After a media change, transfected cells were harvested at 20 hours post-transfection for editing assessment at the PCSK9 locus by NGS as described previously in Example 4. As experimental controls, individual transfections of CasX mRNA #1 and CasX mRNA #2 without gRNAs were performed.

Results

Figure 26:
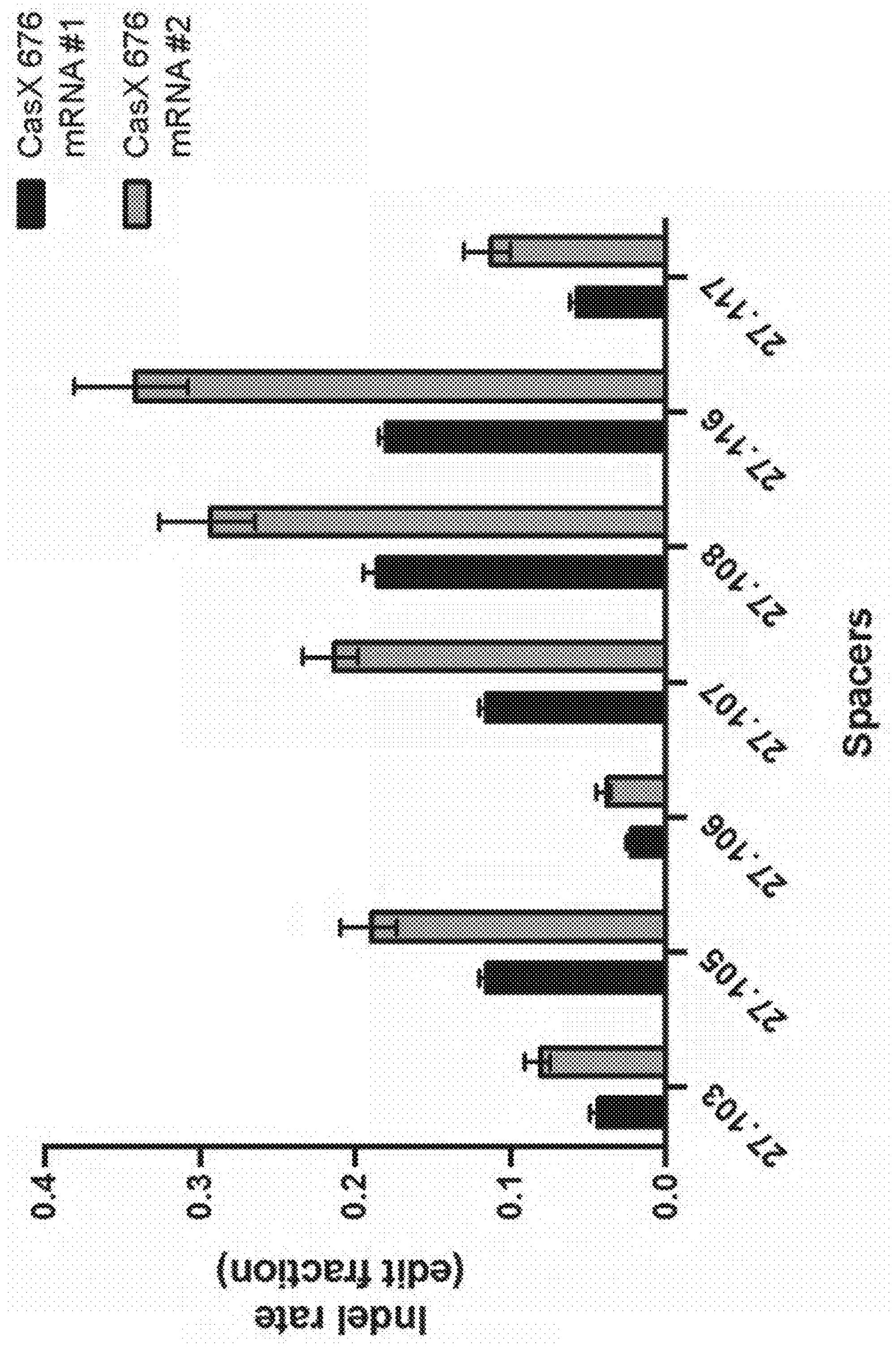
FIG. 26 is a bar graph showing the quantification of percent editing measured as indel rate detected by NGS at the mouse PCSK9 locus in Hepa1-6 cells transfected with the indicated engineered CasX mRNAs and targeting spacers and harvested at 20 hours post-transfection, as described in Example 8.

CasX-mediated editing at the mouse PCSK9 locus was used to evaluate the effects of incorporating different 5' and 3' UTRs into the engineered CasX mRNA. The plot in FIG. 26 shows the quantification of percent editing measured as indel rate at the PCSK9 locus in mouse Hepa1-6 cells transfected with CasX 676 mRNA #1 or CasX 676 mRNA #2 with the indicated PCSK9-targeting gRNAs. The data demonstrate that for all targeting spacers tested in this experiment, CasX mRNA #2 consistently exhibited higher editing levels at the mouse PCSK9 locus compared to editing levels achieved by CasX mRNA #1. Specifically, the highest level of editing rate achieved was with spacer 27.116, where use of CasX mRNA #2 resulted in ~35% editing efficiency compared to ~20% editing level by CasX mRNA #1 (FIG. 26).

The results demonstrate that altering the 5'UTR and 3'UTR sequences of the CasX mRNA can affect the editing activity of CasX at a target locus in a cell-based assay.

Example 9: Design and Assessment of Codon-Optimized CasX mRNA on Editing Efficiency When Delivered Together with Targeting gRNAs In Vitro mRNA sequence and associated modifications can have a significant impact on the efficacy of mRNA-based delivery. Modified nucleotides, including those that encode the 5' cap structure, are important determinants of mRNA stability, translatability, and immunogenicity. Here, for all designed and tested CasX mRNAs, a "Cap 1" structure was used, which included a 5' m7G in a 5'-5' triphosphate linkage to an initiating nucleotide with a 2'Ome modification. This structure, similar to the "Cap 0" structure lacking the 2'Ome modification, promotes efficient translation, and has reduced immunogenicity compared to the "Cap 0" structure. Furthermore, the use of modified nucleobases can reduce immunogenicity of the mRNA. Here, the N1-methyl-pseudouridine was used to substitute the uridine ribonucleoside for all in vitro transcription reactions, since published studies have demonstrated that the N1-methyl-pseudouridine substantially enhances mRNA performance and reduces mRNA immunogenicity. The modifications are expected to result in reduced immunogenicity and higher translation rates in vivo, potentially by avoiding activation of RIG-I, a primary cytosolic sensor for double-stranded RNA, which is a common contaminant of in vitro transcribed mRNA.

Optimization of the poly(A) tail will also be explored. The poly(A) tail is required for translation and mRNA stability, with longer tails being associated with a longer mRNA half-life. Polyadenylation can be carried out post-transcriptionally with a poly(A) polymerase, but this results in variable tail lengths and adds a step to the mRNA production process. mRNA productions were conducted using plasmids containing a template 80A-tail, terminating with a Type IIS restriction site to allow for run-off transcription, as constructs with plasmids containing a template 120A-tail were unstable during propagation in *E. coli*, often resulting in clones with significant reductions in tail length. Alternate plasmids were also cloned with a SphI restriction site between two-60A stretches, since published studies have demonstrated that similar constructs were more stable during subcloning and amplification in *E. coli* and produced mRNA with equivalent activity in mammalian cells. These alternate versions will be compared for activity using an in vitro editing assay across a range of CasX mRNA and gRNA doses to determine the consequential effects on editing activity. The sequences of the poly(A) tails described herein are listed in Table 36.

The sequences encoding the 5' and 3' UTRs, as well as the codons used for the CasX protein-coding sequences, are also critical for effective translation. UTRs were selected from annotated human gene transcripts based on genes (e.g., those encoding the α-globin, β-globin proteins) previously characterized to have high mRNA stability, as well as genes expected or previously demonstrated to be particularly well-expressed in the liver (i.e., genes encoding for the following proteins: albumin, complement 3, and cytochrome P450 2E1). The sequences of the 5' and 3' UTRs from these various genes are listed in Table 36. For the 3' UTR, concatenations of individual 3' UTRs were also tested. These constructs were cloned into plasmids containing a T7 promoter, CasX variant 515 or 676, and a poly(A) tail. To isolate the effects of individual 5' and 3' UTRs, each UTR was cloned into a construct that contained either the 3' or 5' α-globin UTR, respectively. IVTs will be performed and purified by binding to poly(dT) beads to capture full-length transcripts. The resulting mRNAs will initially be assessed by co-transfection with a B2M-targeting gRNA into HepG2 cells using a range of doses. Editing efficiency will be determined by HLA-immunostaining and flow cytometry as described in Example 7. The best-performing individual UTRs will be combined into various configurations, formulated into LNP, and tested in primary human hepatocytes and in mice.

Alternate codon optimizations are also being explored. In addition to the CasX codon optimization used for other delivery modalities, new versions were designed by building a codon usage table based on ribosomal protein codon usage and rebalancing CasX codon usage to match. In addition to potential improvements to the translation rate, this also effectively results in depletion of uracil bases, which may reduce immunogenicity. This codon optimization was also used for production of mRNAs. Additional codon usages have been designed using a variety of available codon optimization tools, adjusting settings as needed to achieve a range of GC content levels. These codon optimizations will be tested under a similar experimental design used for testing UTRs as described above, and the leading codon-optimized CasX candidates will be combined with leading UTR candidates to generate new CasX leads for further validation.

TABLE 36

List of encoding DNA sequences for the indicated elements used for the generation and optimization of CasX mRNA.

| Description | Encoding Sequence | SEQ ID NO: |
|---|---|---|
| | Poly(A) tails | |
| A80 | AAAAAAAAAAAAAAAAAAAAAAAAAAAAAAAAAAAAAAAAAAAAAAAAAAAAAAAAA<br>AAAAAAAAAAAAAAAAAAAAAAA | 3057 |
| A120 | AAAAAAAAAAAAAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAAAA<br>AAAAAA | 3198 |
| $A_{60}$SphI$A_{60}$ | AAAAAAAAAAAAAAAAAAAAAAAAAAAAAAAAAAAAAAAAAAAAAAAAAAAAAAAAA<br>AAAGCATGCAAAAAAAAAAAAAAAAAAAAAAAAAAAAAAAAAAAAAAAAAAAAAAAA<br>AAAAAAAAAAAA | 3199 |
| | 5' UTRs | |
| α-globin | ACTCTTCTGGTCCCCACAGACTCAGAGAGAACCC | 3200 |
| β-globin | ACATTTGCTTCTGACACAACTGTGTTCACTAGCAACCTCAAACA | 3201 |
| Albumin | CTAGCTTTTCTCTTCTGTCAACCCCACACGCCTTT | 3202 |
| Cytochrome P450 2E1 (CYP2E1) | CTCCCGGGCTGGCAGCAGGGCCCCAGC | 3203 |
| Complement 3 (C3) | ACTCCTCCCCATCCTCTCCCTCTGTCCCTCTGTCCCTCTGACCCTGCACTGTCCC | 3204 |
| | 3' UTRs | |
| α-globin | GCTGGAGCCTCGGTGGCCATGCTTCTTGCCCCTTGGGCCTCCCCCCAGCCCCTCCTC<br>CCCTTCCTGCACCCGTACCCCCGTGGTCTTTGAATAAAGTCTGAGTGGGCGGCA | 3189 |
| Albumin | CATCACATTTAAAAGCATCTCAGCCTACCATGAGAATAAGAGAAAGAAAATGAAGAT<br>CAAAAGCTTATTCATCTGTTTTTCTTTTTCGTTGGTGTAAAGCCAACACCCTGTCTA<br>AAAAACATAAATTTCTTTAATCATTTTGCCTCTTTTCTCTGTGCTTCAATTAATAAA<br>AAATGGAAAGAATCTAATAGAGTGGTACAGCACTGTTATTTTTCAAAGATGTGTTGC<br>TATCCTGAAAATTCTGTAGGTTCTGTGGAAGTTCCAGTGTTCTCTCTTATTCCACTT<br>CGGTAGAGGATTTCTAGTTTCTTGTGGGCTAATTAAATAAATCATTAATACTCTTCT<br>AAGTTATGGATTATAAACATTCAAAATAATATTTTGACATTATGATAATTCTGAATA<br>AAAGAACAAAAACCA | 3205 |
| Albumin (truncated) | GCATCACATTTAAAAGCATCTCAGCCTACCATGAGAATAAGAGAAAGAAAATGAAGA<br>TCAATAGCTTATTCATCTCTTTTTCTTTTTCGTTGGTGTAAAGCCAACACCCTGTCT<br>AAAAAACATAAATTTCTTTAATCATTTTGCCTCTTTTCTCTGTGCTTCAATTAATAA<br>AAAATGGAAAGAACCTAGATCT | 3206 |

TABLE 36-continued

List of encoding DNA sequences for the indicated elements used for the generation and optimization of CasX mRNA.

| Description | Encoding Sequence | SEQ ID NO: |
|---|---|---|
| β-globin | GCTCGCTTTCTTGCTGTCCAATTTCTATTAAAGGTTCCTTTGTTCCCTAAGTCCAAC TACTAAACTGGGGGATATTATGAAGGGCCTTGAGCATCTGGATTCTGCCTAATAAAA AACATTTATTTTCATTGCAA | 3207 |
| α-globin + β-globin | GCTGGAGCCTCGGTGGCCATGCTTCTTGCCCCTTGGGCCTCCCCCCAGCCCCTCCTC CCCTTCCTGCACCCGTACCCCCGTGGTCTTTGAATAAAGTCTGAGTGGGCGGCAGCT CGCTTTCTTGCTGTCCAATTTCTATTAAAGGTTCCTTTGTTCCCTAAGTCCAACTAC TAAACTGGGGGATATTATGAAGGGCCTTGAGCATCTGGATTCTGCCTAATAAAAAAC ATTTATTTTCATTGCAA | 3208 |
| β-globin + α-globin | GCTCGCTTTCTTGCTGTCCAATTTCTATTAAAGGTTCCTTTGTTCCCTAAGTCCAAC TACTAAACTGGGGGATATTATGAAGGGCCTTGAGCATCTGGATTCTGCCTAATAAAA AACATTTATTTTCATTGCAAGCTGGAGCCTCGGTGGCCATGCTTCTTGCCCCTTGGG CCTCCCCCCAGCCCCTCCTCCCCTTCCTGCACCCGTACCCCCGTGGTCTTTGAATAA AGTCTGAGTGGGCGGCA | 3209 |

Example 10: Proof-of-Concept Experiment Demonstrating Delivery of LTRP mRNA and Targeting gRNA Via LNPs to Achieve Repression of Target Locus In Vitro Experiments were performed to assess whether delivery of lipid nanoparticles (LNPs) encapsulating LTRP mRNA and a PCSK9-targeting gRNA could induce durable repression of the target PCSK9 locus in a cell-based assay. LNPs encapsulating an mRNA encoding for catalytically-active CasX 515 were formulated and included for comparison.

Materials and Methods

Generation of mRNAs:

mRNA encoding the following molecules were generated by IVT following similar methods as described in Example 2:1) a catalytically-active CasX 515 and 2) LTRP5-ADD-ZIM3 (as described in Example 4). Briefly, for the generation of CasX 515, constructs encoding for a synthetic 5'UTR, a codon-optimized CasX 515 with flanking c-MYC NLSes, and a 3'UTR derived from the mouse hemoglobin alpha (mHBA) were cloned into a plasmid containing a T7 promoter and 79-nucleotide poly(A) tail. The resulting plasmid was linearized prior to use for IVT reactions, which were performed as similarly described in Example 2. The DNA and mRNA sequences encoding the catalytically-active CasX 515 are shown in Table 37 and Table 38 respectively. The DNA and mRNA sequences encoding for LTRP5-ADD-ZIM3 are shown in Table 18 and Table 19 respectively.

TABLE 37

Encoding sequences of the catalytically-active CasX 515 mRNA molecule assessed in this example*.

| CasX mRNA ID | Component (ID) | Description | DNA sequence or SEQ ID NO: |
|---|---|---|---|
| CasX 515 mRNA | 5'UTR | Synthetic (TriLink) | 3274 |
| | START codon + c-MYC NLS | | 3275 |
| | CasX 515 | | 3276 |
| | c-MYC NLS + STOP codon | | 3277 |
| | 3'UTR | Mouse HBA | 3278 |
| | XbaI restriction site (partial) | | TCTAG |
| | Poly(A) tail | | 3279 |

*Components are listed in a 5' to 3' order within the constructs

TABLE 38

Full-length RNA sequences of catalytically-active CasX 515 mRNA molecule assessed in this example. Modification 'mψ' = N1-methyl-pseudouridine.

| CasX mRNA | SEQ ID NO | RNA Sequence |
|---|---|---|
| CasX 515 mRNA | 3280 | AAAmψAAGAGAGAAAAGAAG AGmψAAGAAGAAAmψAmψAA GAGCCACCAmψGGCCCCmψG CmψGCCAAGAGAGmψGAAGC mψGGAmψAGCAGACAGGAGA mψCAAGCGGAmψmψAAmψAA AAmψmψCGGAGAAGACmψGG mψGAAGGAmψmψCmψAACAC AAAGAAGGCmψGGCAAGACA GGCCCmψAmψGAAGACACmψ GCmψGGmψGAGAGmψGAmψG ACACCCGACCmψGAGAGAAA GACmψGGAAAACCmψGAGAA AGAAGCCmψGAGAAmψAmψC CCCCAGCCCAmψCAGCAACA |

TABLE 38-continued

Full-length RNA sequences of catalytically-active CasX 515 mRNA molecule assessed in this example. Modification 'mψ' = N1-methyl-pseudouridine.

| CasX mRNA | SEQ ID NO | RNA Sequence |
|---|---|---|
| | | CAAGCCGGGCCAACCmψGAA |
| | | mψAAGCmψGCmψGACCGACm |
| | | ψACACCGAAAmψGAAGAAGG |
| | | CCAmψCCmψGCACGmψGmψA |
| | | mψmψGGGAAGAGmψmψCCAG |
| | | AAAGACCCAGmψCGGCCmψG |
| | | AmψGAGCAGAGmψGGCmψCA |
| | | GCCmψGCCAGCAAGAAGAmψ |
| | | CGAmψCAGAACAAGCmψGAA |
| | | GCCCGAAAmψGGACGAGAAG |
| | | GGGAACCmψGACAACCGCCG |
| | | GCmψmψmψGCCmψGmψAGCC |
| | | AGmψGCGGCCAGCCCCmψGm |
| | | ψmψmψGmψGmψACAAACmψG |
| | | GAACAGGmψGAGCGAAAAGG |
| | | GCAAGGCmψmψACACGAAmψ |
| | | mψACmψmψCGGCAGAmψGCA |
| | | ACGmψGGCCGAGCACGAGAA |
| | | GCmψGAmψCCmψGCmψGGCC |
| | | CAGCmψGAAGCCmψGAGAAG |
| | | GAmψAGCGAmψGAGGCAGmψ |
| | | GACAmψAmψmψCCCmψGGGC |
| | | AAGmψmψCGGACAGCGGGCC |
| | | CmψGGAmψmψmψmψmψAmψm |
| | | ψCCAmψmψCAmψGmψGACCA |
| | | AGGAAmψCCACCCACCCCGm |
| | | ψCAAGCCmψCmψmψGCCCAA |
| | | AmψmψGCCGGCAACAGAmψA |
| | | CGCCAGCGGCCCCGmψGGGC |
| | | AAGGCCCmψGAGCGACGCCm |
| | | ψGmψAmψGGGCACCAmψCGC |
| | | CAGCmψmψCCmψGmψCmψAA |
| | | GmψACCAGGACAmψmψAmψC |
| | | AmψCGAGCACCAGAAGGmψG |
| | | GmψGAAGGGCAACCAGAAGA |
| | | GACmψGGAGAGCCmψGCGCG |
| | | AGCmψGGCCGGCAAGGAAAA |
| | | CCmψGGAGmψAmψCCmψAGC |
| | | GmψGACCCmψGCCmψCCmψC |
| | | AGCCmψCAmψACAAAGGAGG |
| | | GCGmψGGAmψGCCmψACAAC |
| | | GAAGmψGAmψCGCCCGGGmψ |
| | | GCGGAmψGmψGGGmψGAACC |
| | | mψGAAmψCmψGmψGGCAGAA |
| | | GCmψGAAGCmψGmψCmψAGA |
| | | GACGACGCCAAGCCCCmψGC |
| | | mψGAGACmψGAAGGGCmψmψ |
| | | CCCCAGCmψmψCCCmψCmψG |
| | | GmψGGAGAGACAGGCAAAmψ |
| | | GAAGmψGGACmψGGmψGGGA |
| | | CAmψGGmψGmψGmψAACGmψ |
| | | GAAGAAGCmψGAmψCAAmψG |
| | | AGAAGAAGGAGGACGGCAAA |
| | | GmψGmψmψCmψGGCAGAAmψ |
| | | CmψGGCCGGCmψACAAGCGm |
| | | ψCAGGAGGCCCmψGCGGCCC |
| | | mψACCmψGAGCAGCGAGGAA |
| | | GACAGAAAGAAGGGCAAGAA |
| | | GmψmψCGCCCGGmψAmψCAG |
| | | CmψGGGGGACCmψGCmψGCm |
| | | ψGCACCmψCGAGAAGAAGCA |
| | | CGGCGAAGACmψGGGGGAAG |
| | | GmψGmψACGAmψGAGGCCmψ |
| | | GGGAGCGGAmψCGAmψAAGA |
| | | AGGmψGGAGGGCCmψGAGCA |
| | | AGCACAmψCAAGCmψGGAGG |
| | | AGGAACGGAGAmψCmψGAGG |
| | | ACGCCCAGAGCAAGGCCGCC |
| | | CmψGACCGACmψGGCmψGAG |
| | | AGCCAAGGCCAGCmψmψCGm |
| | | ψCAmψCGAGGGGCmψGAAGG |

TABLE 38-continued

Full-length RNA sequences of catalytically-active CasX 515 mRNA molecule assessed in this example. Modification 'mψ' = N1-methyl-pseudouridine.

| CasX mRNA | SEQ ID NO | RNA Sequence |
|---|---|---|
| | | AGGCCGACAAGGACGAGmψm |
| | | ψCmψGCCGGmψGCGAACmψG |
| | | AAGCmψGCAGAAGmψGGmψA |
| | | CGGAGAmψCmψGAGAGGCAA |
| | | ACCmψmψmψCGCCAmψCGAG |
| | | GCCGAGAACAGCAmψCCmψG |
| | | GACAmψCAGCGGCmψmψCAG |
| | | CAAGCAGmψACAACmψGCGC |
| | | CmψmψmψAmψmψmψGGCAGA |
| | | AGGACGGAGmψGAAGAAGCm |
| | | ψGAACCmψGmψACCmψGAmψ |
| | | CAmψCAACmψAmψmψmψCAA |
| | | GGGCGGCAAGCmψGAGAmψm |
| | | ψCAAGAAGAmψCAAGCCmψG |
| | | AAGCCmψmψCGAGGCCAACA |
| | | GAmψmψCmψACACCGmψGAm |
| | | ψmψAACAAGAAAAGCGGAGA |
| | | GAmψCGmψGCCAAmψGGAAG |
| | | mψGAACmψmψCAACmψmψCG |
| | | ACGACCCmψAACCmψGAmψC |
| | | AmψCCmψGCCCCmψGGCAmψ |
| | | mψmψGGCAAGCGGCAGGGCA |
| | | GAGAGmψmψCAmψCmψGGAA |
| | | CGACCmψGCmψGmψCmψCmψ |
| | | GGAGACCGGCAGCCmψGAAG |
| | | CmψGGCCAACGGCAGAGmψG |
| | | AmψCGAGAAGACACmψGmψA |
| | | CAACAGACGAACCAGACAAG |
| | | ACGAGCCCGCCCmψGmψmψm |
| | | ψGmψGGCCCmψGACCmψmψC |
| | | GAGAGAAGAGAGGmψGCmψG |
| | | GACAGCAGCAAmψAmψCAAG |
| | | CCmψAmψGAACCmψGAmψCG |
| | | GCGmψGGACCGGGGCGAGAA |
| | | CAmψCCCmψGCCGmψGAmψC |
| | | GCCCmψmψACCGACCCCGAG |
| | | GGAmψGCCCmψCmψGAGCCG |
| | | GmψmψmψAAAGACAGCCmψG |
| | | GGCAACCCmψACCCACAmψC |
| | | CmψGAGAAmψmψGGCGAGmψ |
| | | CCmψACAAGGAGAAGCAGAG |
| | | AACCAmψCCAGGCCAAGAAG |
| | | GAGGmψGGAGCAGCGGCGGG |
| | | CmψGGCGGCmψACmψCCCGG |
| | | AAGmψACGCCAGCAAGGCCA |
| | | AGAACCmψGGCCGACGACAm |
| | | ψGGmψmψAGAAAmψACCGCC |
| | | AGAGACCmψCCmψGmψACmψ |
| | | ACGCmψGmψGACCCAGGACG |
| | | CCAmψGCmψGAmψCmψmψCG |
| | | AGAACCmψGAGCAGAGGCmψ |
| | | mψCGGCAGACAGGGCAAGAG |
| | | AACCmψmψCAmψGGCCGAGA |
| | | GACAGmψACACCCGGAmψGG |
| | | AGGACmψGGCmψGACCGCCA |
| | | AGCmψGGCCmψACGAGGGCC |
| | | mψGCCCmψCmψAAGACCmψA |
| | | CCmψGmψCCAAGACCmψmψG |
| | | GCACAGmψACACCAGCAAGA |
| | | CAmψGCmψCmψAACmψGCGG |
| | | CmψmψCACAAmψCACGAGCG |
| | | CCGACmψACGACCGGGmψGC |
| | | mψGGAGAAACmψGAAGAAGA |
| | | CCGCCACAGGCmψGGAmψGA |
| | | CCACCAmψmψAACGGCAAGG |
| | | AGCmψGAAGGmψGGAGGGCC |
| | | AGAmψCACCmψACmψACAAC |
| | | AGGmψACAAACGGCAGAACG |
| | | mψGGmψGAAGGACCmψGAGC |
| | | GmψGGAACmψGGAmψAGACm |
| | | ψGAGCGAGGAAAGCGmψAAA |

TABLE 38-continued

Full-length RNA sequences of catalytically-active CasX 515 mRNA molecule assessed in this example. Modification 'mψ' = N1-methyl-pseudouridine.

| CasX mRNA | SEQ ID NO | RNA Sequence |
|---|---|---|
| | | CAAmψGACAmψCAGCAGCmψ<br>GGACCAAGGGCCGGAGCGGC<br>GAGGCCCmψGAGCCmψGCmψ<br>GAAGAAGAGAmψmψCmψCCC<br>ACAGACCAGmψGCAGGAGAA<br>GmψmψCGmψGmψGmψCmψGA<br>ACmψGCGGCmψmψCGAGACC<br>CACGCCGACGAGCAAGCCGC<br>CCmψGAACAmψCGCCCGGmψ<br>CmψmψGGCmψmψmψmψCCmψ<br>GCGGAGCCAGGAGmψACAAG<br>AAGmψACCAGACAAACAAGA<br>CCACAGGCAACACAGACAAG<br>AGAGCCmψmψCGmψCGAGAC<br>CmψGGCAGAGCmψmψCmψAC<br>AGAAAGAAGCmψGAAGGAGG<br>mψGmψGGAAGCCmψGCCGmψ<br>GGGAAGCCCCGCmψGCCAAG<br>AGAGmψGAAGCmψGGACmψA<br>AGCmψGCCmψmψCmψGCGGG<br>GCmψmψGCCmψmψCmψGGCC<br>AmψGCCCmψmψCmψmψCmψC<br>mψCCCmψmψGCACCmψGmψA<br>CCmψCmψmψGGmψCmψmψmψ<br>GAAmψAAAGCCmψGAGmψAG<br>GAAGmψCmψAGAAAAAAAAA<br>AAAAAAAAAAAAAAAAAAAA<br>AAAAAAAAAAAAAAAAAAAA<br>AAAAAAAAAAAAAAAAAAAA<br>AAAAAAAAAA |

Figure 24:
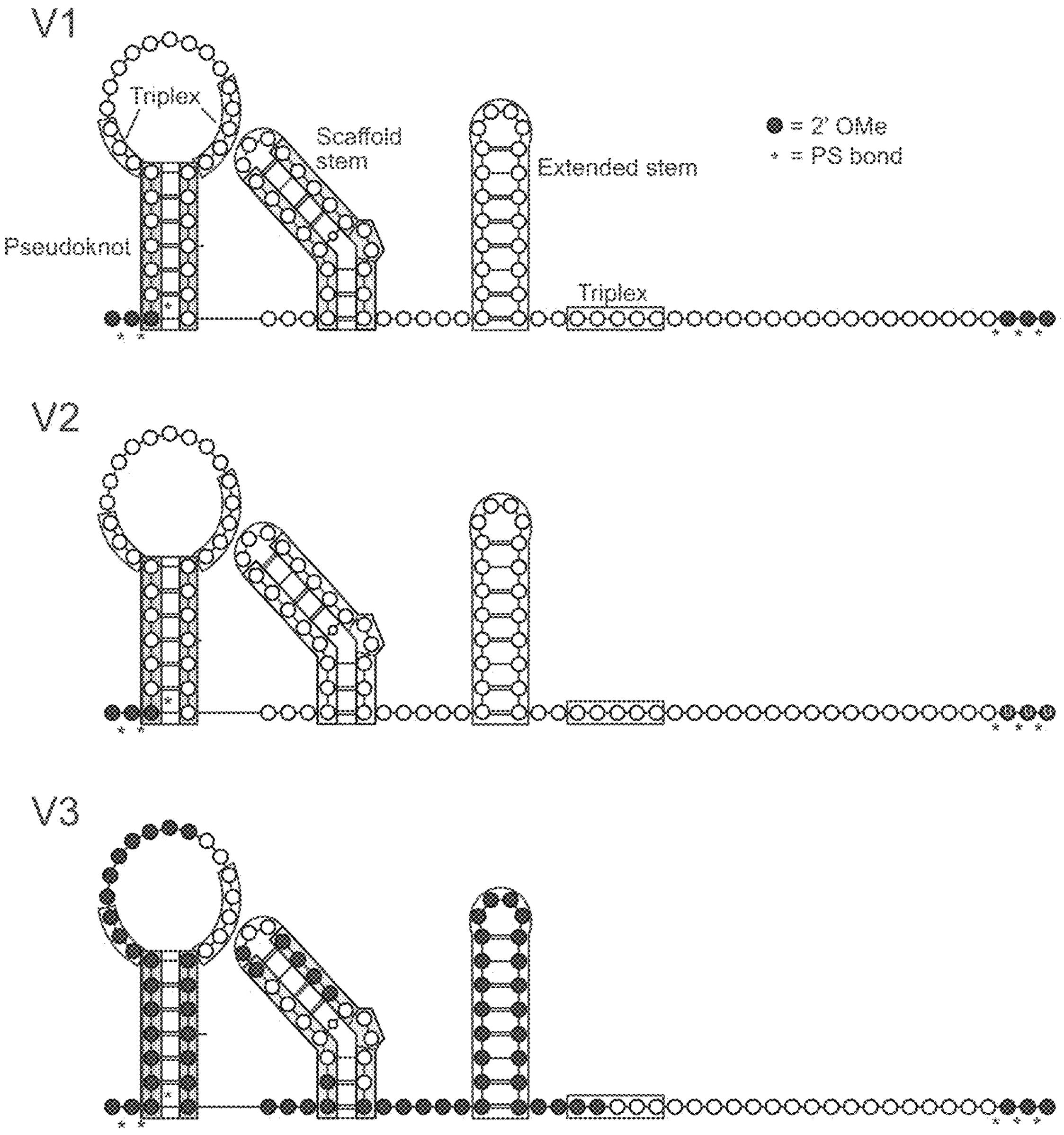
FIG. 24 is a schematic illustrating versions 1-3 of chemical modifications made to gRNA scaffold variant 316, as described in Example 7. Structural motifs are highlighted. Standard ribonucleotides are depicted as open circles, and 2'OMe-modified ribonucleotides are depicted as black circles. Phosphorothioate bonds are indicated with * below or beside the bond.
Figure 25:
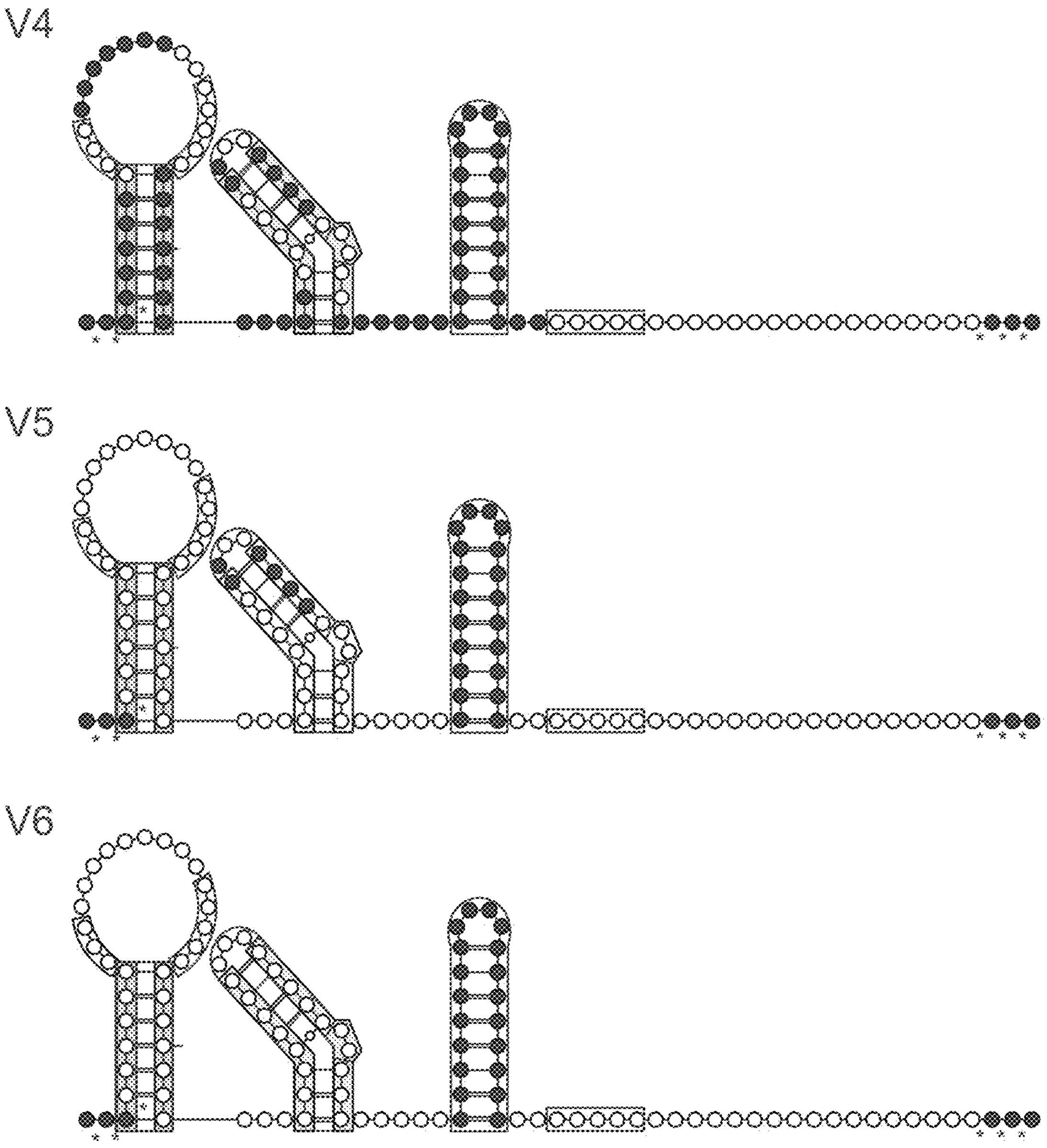
FIG. 25 is a schematic illustrating versions 4-6 of chemical modifications made to gRNA scaffold variant 316, as described in Example 7. Structural motifs are highlighted. Standard ribonucleotides are depicted as open circles, and 2'OMe-modified ribonucleotides are depicted as black circles. Phosphorothioate bonds are indicated with * below or beside the bond.

Synthesis of gRNAs:

PCSK9-targeting gRNAs were designed using gRNA scaffold 316 and spacer 6.1 (sequence listed in Table 24) and chemically synthesized. The sequence of the PCSK9-targeting gRNA with the v1 modification profile (as described in Example 7 above) is listed in Table 39. A schematic of the sites of chemical modifications for a 'v1' profile of the gRNA scaffold variant 316 is shown in FIG. 24.

TABLE 39

Sequences of chemically modified the gRNA targeting the human PCSK9 locus assayed in this example.

| gRNA ID (scaffold variant-spacer) | Target | gRNA sequence | SEQ ID NO |
|---|---|---|---|
| 316-6.1 (v1) | human PCSK9 | mA*mC*mU*GGCGCU<br>UCUAUCUGAUUACUC<br>UGAGCGCCAUCACCA<br>GCGACUAUGUCGUAG<br>UGGGUAAAGCUCCCU<br>CUUCGGAGGGAGCAU<br>CAGAGGAGGAGGACG<br>GCCUGGC*mC*mG*m<br>A | 3443 |

LNP formulations were generated with the LNP lipids as listed in Table 40, using methods described in Example 11, below.

Delivery of LNPs Encapsulating LTRP or CasX mRNA and Targeting gRNA into Primary Cynomolgus Macaque (CM) Hepatocytes:

Two lots (termed BJE and VDU) of primary CM hepatocytes derived from two different donors (product number: M003055-P; BioIVT®), were used to assess LTRP-mediated repression or CasX-mediated editing at the PCSK9 locus when delivered by LNPs. For each lot, ~50,000 cells, cultured in Williams' E complete media, were seeded per well in a 96-well plate. The next day, seeded cells were treated with varying concentrations of LNPs, which were prepared in six 3-fold serial dilutions starting at 1,200 ng/100 μL. These LNPs were formulated to co-encapsulate CasX 515 or LTRP5-ADD-ZIM3 mRNA and a PCSK9-targeting gRNA incorporating scaffold variant 316 with spacer 6.1 (v1; see Table 39). The LNP formulations tested in this example are shown in Table 40. Media was changed one day after LNP treatment, and cells were cultured for additional days prior to harvesting the media supernatant to measure PCSK9 secretion levels at the day 4 and day 11 timepoints. Briefly, PCSK9 secretion levels were measured by ELISA using the BioLegend® ELISA MAX™ kit following the manufacturer's instructions. To ensure accuracy in quantifying PCSK9 secretion levels, a standard curve was constructed using recombinant CM PCSK9 protein as a reference (Cynomolgus PCSK9 protein, from Acro Biosystems®). Baseline PCSK9 secretion levels (ng/mL) were also quantified for untreated primary CM hepatocytes (for each lot) at day 4.

TABLE 40

LNP formulations tested in this example.

| LNP lipid | Encapsulated mRNA | Encapsulated gRNA |
|---|---|---|
| Gen Voy-ILM™ | CasX 515 | gRNA scaffold 316 with spacer 6.1 (v1) |
| MC3 | | |
| MC3 | LTRP5-ADD-ZIM3 | |
| ALC-0315 | | |
| SM-102 | | |

Results

Two lots of primary CM hepatocytes were treated with five different LNPs, which co-encapsulated either CasX 515 or LTRP5-ADD-ZIM3 and a PCSK9-targeting gRNA using spacer 6.1, at various doses. The media supernatant was harvested 4 and 11 days post-treatment to assess effects on PCSK9 secretion (FIGS. 61-64). The results in FIGS. 61-64 demonstrate that either LTRP5-ADD-ZIM3 or CasX mRNA and the targeting gRNA could be co-encapsulated within the various LNPs, and were delivered to target cells where they reduced secreted PCSK9 levels. Dose-dependent reduction in secreted PCSK9 levels was observed for all formulated LNPs in both lots of primary CM hepatocytes at 4 days post-treatment (FIGS. 61-62). By 11 days post-treatment, dose-dependent reduction in secreted PCSK9 levels was observed for all formulated LNPs in both lots, with the exception of MC3-encapsulating LTRP5-ADD-ZIM3 and the targeting gRNA (FIGS. 63-64). Secreted PCSK9 levels will be examined at longer timepoints to determine further the effects of each LNP formulation on decreasing PCSK9 secretion.

The results from this experiment show that LTRP mRNA, as well as CasX mRNA, and targeting gRNA can be co-encapsulated within LNPs to be delivered to target cells to induce silencing of a target endogenous locus.

Example 11: Formulation of Lipid Nanoparticles (LNPs) to Deliver dXR or LTRP mRNA and gRNA Payloads to Target Cells and Tissue As described in Example 10, experiments were performed to encapsulate dXR or LTRP mRNA and gRNA into LNPs for delivery to target cells and tissues. The following example provides the methods used for formulating LNPs with various LNP lipids.

For Experiments that Used Gen Voy-ILM™-Based LNPs:

dXR or LTRP mRNA and gRNA were encapsulated into LNPs using GenVoy-ILM™ lipids using the Precision NanoSystems Inc. (PNI) Ignite™ Benchtop System, following the manufacturer's guidelines. Gen Voy-ILM™ lipids are a composition of ionizable lipid:DSPC:cholesterol:stabilizer at 50:10:37.5:2.5 mol %. Briefly, to formulate LNPs, equal mass ratios of dXR or LTRP mRNA and gRNA were diluted in PNI Formulation Buffer, pH 4.0. Gen Voy-ILM™ lipids were diluted 1:1 in anhydrous ethanol. mRNA/gRNA co-formulations were generated using a predetermined N/P ratio. The RNA and lipids were run through a PNI laminar flow cartridge at a predetermined flow rate ratio on the PNI Ignite™ Benchtop System. After formulation, the LNPs were diluted in PBS, pH 7.4, to decrease the ethanol concentration and increase the pH, which would increase the stability of the particles. Buffer exchange of the mRNA/sgRNA-LNPs was achieved by overnight dialysis into PBS, pH 7.4, at 4° C. using 10k Slide-A-Lyzer™ Dialysis Cassettes (Thermo Scientific™). Following dialysis, the mRNA/gRNA-LNPs was concentrated to >0.5 mg/mL using 100 kDa Amicon®-Ultra Centrifugal Filters (Millipore) and then filter-sterilized. Formulated LNPs were analyzed on a Stunner® (Unchained Labs) to determine their diameter and polydispersity index (PDI). Encapsulation efficiency and RNA concentration was determined by RiboGreen™ assay using Invitrogen's Quant-iT™ RiboGreen™ RNA assay kit.

For experiments that used ALC-0315 (6-((2-hexyldecanoyl)oxy)-N-(6-((2-hexyldecanoyl)oxy)hexyl)-N-(4-hydroxybutyl)hexan-1-aminium), SM-102 (8-[(2-hydroxyethyl) [6-oxo-6-(undecyloxy)hexyl]amino]-octanoic acid, 1-octylnonyl ester), and MC3 (DLin-MC3-DMA)-based LNPs:

dXR or LTRP mRNA and gRNA were encapsulated into LNPs using ALC-0315, SM-102, or MC3-based lipid mix using a custom-made T-mixer micro mixing device, at a flow rate of 20 mL/min and 3:1 mixing ratio of aqueous to organic phase. For all three lipid mixes, the composition was the following: ionizable lipid:DSPC:cholesterol:DMG-PEG2000 at 50:10:38.5:1.5 mol %. Briefly, to formulate LNPs, equal mass ratios of dXR or LTRP mRNA and gRNA were diluted in 25 mM sodium acetate, pH 4.0. The lipid mix was made at a 10 mM concentration in anhydrous ethanol. mRNA/gRNA co-formulations were generated using a predetermined N/P ratio. The RNA and lipids are run through a custom-made T-mixer device at a predetermined flow rate ratio using syringe pump infusers. After formulation, the LNPs were dialyzed into PBS, pH 7.4, to decrease the ethanol concentration and increase the pH, which increases the stability of the particles. Buffer exchange of the mRNA/sgRNA-LNPs was achieved by overnight dialysis into PBS, pH 7.4, at 4° C. using 10k Slide-A-Lyzer™ Dialysis or Cassettes (Thermo Scientific™) or 12-14 kDa dialysis tubing (Repligen). Following dialysis, the mRNA/gRNA-LNPs was concentrated to >0.2 mg/mL using 30-100 kDa Amicon®-Ultra Centrifugal Filters (Millipore) and then sterile-filtered using Acrodisc PES membrane filters. Formulated LNPs were analyzed on a Malvern Zetasizer to determine their diameter and polydispersity index (PDI). Encapsulation efficiency and RNA concentration was determined by RiboGreen™ assay using Invitrogen's Quant-iT™ RiboGreen™ RNA assay kit.

The Gen Voy-ILM™, ALC-0315, SM-102, and MC3 LNPs described above were used in various experiments to deliver XR or LTRP mRNA and gRNA to target cells, and can further be used for delivery to target tissues.

Example 12: CpG-Depletion of DNA Encoding the Guide RNA Scaffold Improves CasX-Mediated Editing In Vitro Pathogen-associated molecular patterns (PAMPs), such as unmethylated CpG motifs, are small molecular motifs conserved within a class of microbes. They are recognized by toll-like receptors (TLRs) and other pattern recognition receptors in eukaryotes and often induce a non-specific immune activation. In the context of gene therapy, therapeutics containing PAMPs are often not as well-tolerated and are rapidly cleared from the patient given the strong immune response triggered, which ultimately leads to reduced therapeutic efficacy. CpG motifs are short single-stranded DNA sequences containing the dinucleotide CG. When these CpG motifs are unmethylated, they act as PAMPs and therefore stimulate the immune response. In this example, experiments were performed to deplete CpG motifs in the guide scaffold coding sequence in the context of an AAV construct encoding CasX variant 491, guide scaffold variant 235, and spacer 7.37 targeting the endogenous B2M (beta-2-microglobulin) locus, and test the effect of CpG-depletion in the guide scaffold on editing of the B2M locus in vitro.

Materials and Methods

Design of CpG-Depleted Guide Scaffolds:

Nucleotide substitutions were rationally-designed to replace native CpG motifs within the base gRNA scaffold variant (gRNA scaffold 235) with the intent to preserve editing activity while reducing scaffold immunogenicity. It was believed that as many CpG-motifs as possible should be removed from the scaffold coding sequence in order to sufficiently reduce immunogenicity. Scaffold 235 contains a total of eight CpG elements; six of which are predicted to basepair and form complementary strands of a double-stranded secondary structure (see FIG. 27A). Therefore, the six basepairing CpGs forming three pairs were mutated in concert to maintain important secondary structures. This reduced the number of independent CpG-containing regions to five (three pairs and two single CpGs) to be considered independently for CpG-removal. Specifically, mutations were designed in (1) the pseudoknot stem, (2) the scaffold stem, (3) the extended stem bubble, (4) the extended step, and (5) the extended stem loop, as diagrammed in FIG. 27B and described in detail below.

In the pseudoknot stem (region 1), the CpG pair was flipped to a GpC to minimize the alteration of the base composition and sequence. Based on previous experiments involving replacing individual base pairs, it was anticipated that this mutation was not likely to be detrimental to the structure and function of the guide RNA scaffold.

Similarly, in the scaffold stem (region 2) the CpG pair was flipped to a GpC to minimize the alteration of the base composition and sequence. It was anticipated that this mutation was likely to be detrimental to the structure and function of the guide RNA scaffold because strong sequence conservation was seen in this region in previous experiments mutating individual bases or base pairs. This strong sequence conservation is likely due to the scaffold stem loop being important in interacting with the CasX protein as well as in the formation of a triplex structural element with the pseudoknot region.

In the extended stem bubble (region 3) the single CpG was removed by one of three strategies. First, the bubble was deleted by mutating CG→C. Second, the bubble was resolved to restore ideal basepairing by mutating CG→CT. Third, the entire extended stem loop was replaced with the extended stem loop of scaffold 174. Note that, by itself, the replacement of the extended stem loop with that of scaffold 174 recapitulates scaffold 316, which has previously been shown to edit efficiently. There are no CpG motifs in the extended stem loop of scaffold 174. Therefore, replacing the extended stem loop with that of scaffold 174 also removes the CpG motif in the extended stem (region 4). Based on previous experiments showing the relative robustness of the extended stem to small changes, it was anticipated that mutating the extended stem bubble was moderately likely to be detrimental to the structure and function of the guide RNA scaffold.

In the extended stem (region 4), the CpG pair could not be flipped to GpC without generating additional CpG motifs. Therefore, the CpGs were changed to a GG and a complementary CC motif. Similar to region 3, based on the relative robustness of the extended stem to small changes, it was anticipated that this mutation was not likely to be detrimental to the structure and function of the guide RNA scaffold.

Finally, the extended stem loop (region 5) was mutated in one of three ways that were designed based on previous experiments examining the stability of the stem loop. In particular, several variations of the stem loop had previously been shown to have similar stability levels, and some of these variations of the stem loop do not contain CpGs. Based on these findings, first, the loop was replaced with a new loop with a CUUG sequence. Second, the loop was replaced with a new loop with a GAAA sequence. Since the GAAA loop replacement would generate a novel CpG adjacent to the loop, it was combined with a C→G base swap and the corresponding G→C base swap on the complementary strand, ultimately resulting in a CUUCGG→GGAAAC exchange. Third, the loop was mutated by the insertion of an A to interrupt the CpG motif and thereby increase the size of the loop from 4 to 5 bases. It was anticipated that randomly mutating the extended stem loop would likely have detrimental effects on secondary structure stability and hence on editing. However, relying on previously confirmed sequences was believed to have a lower risk associated with a replacement.

To generate guide RNA scaffolds encoded by DNA with reduced CpG levels, the mutations described above were combined in various configurations. Table 41, below, summarizes combinations of the mutations that were used. In Table 41, a 0 indicates that no mutation was introduced to a given region, a 1, 2, or 3 indicates that a mutation was introduced in that region, as diagrammed in FIG. 27B, and n/a indicates not applicable. Specifically, for region 1, the pseudoknot stem, a 1 indicates that a CG→GC mutation was introduced. For region 2, the scaffold stem, a 1 indicates that a CG→GC mutation was introduced. For region 3, the extended stem bubble, a 1 indicates that the bubble was removed by the deletion of the G and A bases that form the bubble, a 2 indicates that the bubble was resolved by a CG→CU mutation that allows for basepairing between the A and U bases, and a 3 indicates that the extended stem loop was replaced with the extended step loop from guide scaffold 174. For region 4, the extended stem, a 1 indicates that a CG→GC mutation was introduced. For region 5, the extended stem loop, a 1 indicates that the loop was replaced from UUCG→CUUG, a 2 indicates that the loop was replaced along with a basepair adjacent to the loop, from CUUCGG→GGAAAC, and a 3 indicates that an A was inserted between the C and the G.

TABLE 41

Summary of mutations for CpG-reduction and depletion in guide scaffold 235

| Scaffold ID | Region 1 (Pseudoknot stem) | Region 2 (Scaffold stem) | Region 3 (Extended stem bubble) | Region 4 (Extended stem) | Region 5 (Extended stem loop) |
|---|---|---|---|---|---|
| 320 | 1 | 0 | 0 | 1 | 0 |
| 321 | 1 | 0 | 1 | 1 | 0 |
| 322 | 1 | 0 | 2 | 1 | 0 |
| 323 | 1 | 0 | 3 | n/a | 0 |
| 324 | 1 | 0 | 1 | 1 | 1 |
| 325 | 1 | 0 | 2 | 1 | 1 |
| 326 | 1 | 0 | 3 | n/a | 1 |
| 327 | 1 | 0 | 1 | 1 | 2 |
| 328 | 1 | 0 | 2 | 1 | 2 |
| 329 | 1 | 0 | 3 | n/a | 2 |
| 330 | 1 | 0 | 1 | 1 | 3 |
| 331 | 1 | 0 | 2 | 1 | 3 |
| 332 | 1 | 0 | 3 | n/a | 3 |
| 334 | 1 | 1 | 2 | 1 | 1 |
| 335 | 1 | 1 | 3 | n/a | 1 |
| 336 | 1 | 1 | 1 | 1 | 2 |
| 337 | 1 | 1 | 2 | 1 | 2 |
| 338 | 1 | 1 | 3 | n/a | 2 |
| 339 | 1 | 1 | 1 | 1 | 3 |
| 340 | 1 | 1 | 2 | 1 | 3 |
| 341 | 1 | 1 | 3 | n/a | 3 |
| 235 | 0 | 0 | 0 | 0 | 0 |

Table 42, below, lists the DNA sequences encoding the designed CpG-reduced or depleted guide scaffolds.

TABLE 42

DNA sequences encoding CpG-reduced or depleted guide RNA scaffolds

| Scaffold ID | SEQ ID NO |
|---|---|
| 320 | 3210 |
| 321 | 3211 |
| 322 | 3212 |
| 323 | 3213 |
| 324 | 3214 |
| 325 | 3215 |
| 326 | 3216 |
| 327 | 3217 |
| 328 | 3218 |
| 329 | 3219 |
| 330 | 3220 |
| 331 | 3221 |
| 332 | 3222 |
| 333 | 3223 |
| 334 | 3224 |
| 335 | 3225 |
| 336 | 3226 |
| 337 | 3227 |
| 338 | 3228 |

TABLE 42-continued

| DNA sequences encoding CpG-reduced or depleted guide RNA scaffolds | |
|---|---|
| Scaffold ID | SEQ ID NO |
| 339 | 3229 |
| 340 | 3230 |
| 341 | 3231 |

Generation of CpG-Depleted AAV Plasmids:

The CpG-reduced or depleted gRNA scaffolds were tested in the context of AAV vectors that were otherwise CpG-depleted, with the exception of the AAV2 ITRs. Specifically, nucleotide substitutions to replace native CpG motifs in AAV components were designed in silico based on homologous nucleotide sequences from related species for the following elements: the murine Ula snRNA (small nuclear RNA) gene promoter, the bGHpA (bovine growth hormone polyadenylation) sequence, and the human U6 promoter. The coding sequence for CasX 491 was codon-optimized for CpG depletion. All resulting sequences (Tables 42 and 43) were ordered as gene fragments with the appropriate overhangs for cloning and isothermal assembly to replace individually the corresponding elements of the existing base AAV plasmid (construct ID 183). Spacer 7.37 (GGCCGAGAUGUCUCGCUCCG; SEQ ID NO: 3137), which targets the endogenous B2M gene, was used for the experiments discussed in this example. The first time that the experiment was performed ("N=1"), a sample with the non-targeting spacer 0.0 was also included as a control (CGAGACGUAAUUACGUCUCG, SEQ ID NO: 3232; see FIG. 28).

The resulting AAV constructs were generated using standard molecular cloning techniques. Cloned and sequence-validated plasmid constructs were midi-prepped for subsequent nucleofection and AAV vector production. The sequences of the additional components of AAV constructs, with the exception of sequences encoding the gRNAs (Table 41), are listed in Table 43.

TABLE 43

| Sequences of AAV elements (5'-3' in AAV construct) | |
|---|---|
| Element | DNA sequence SEQ ID NO: |
| AAV2 5' ITR | 3233 |
| CpG-depleted Ula promoter | 3234 |
| CpG-depleted cMycNLS-CasX491-cMycNLS | 3235 |
| CpG-depleted bGH-polyA sequence | 3236 |
| CpG-depleted U6 promoter | 3237 |
| See sgRNA sequences in Table 42, above. | |
| AAV2 3' ITR | 3238 |

AAV Production:

Suspension-adapted HEK293T cells, maintained in FreeStyle™ 293 media, were seeded in 20-30 mL of media at 1.5E6 cells/mL on the day of transfection. Endotoxin-free pAAV plasmids with the transgene flanked by ITR repeats were co-transfected with plasmids supplying the adenoviral helper genes for replication and AAV rep/cap genome using PEI Max® (Polysciences®) in serum-free Opti-MEM™ media. Three days later, cultures were centrifuged to separate the supernatant from the cell pellet, and the AAV particles were collected, concentrated, and filtered following standard procedures.

To determine the viral genome (vg) titer, 1 µL from crude lysate viruses was digested with DNase and ProtK, followed by quantitative PCR. 5 L of digested virus was used in a 25 µL qPCR reaction composed of IDT primetime master mix and a set of primer and 6'FAM/Zen/IBFQ probe (IDT) designed to amplify a 62 bp-fragment located in the AAV2-ITR. An AAV ITR plasmid was used as reference standards to calculate the titer (vg/mL) of viral samples.

Figure 29:
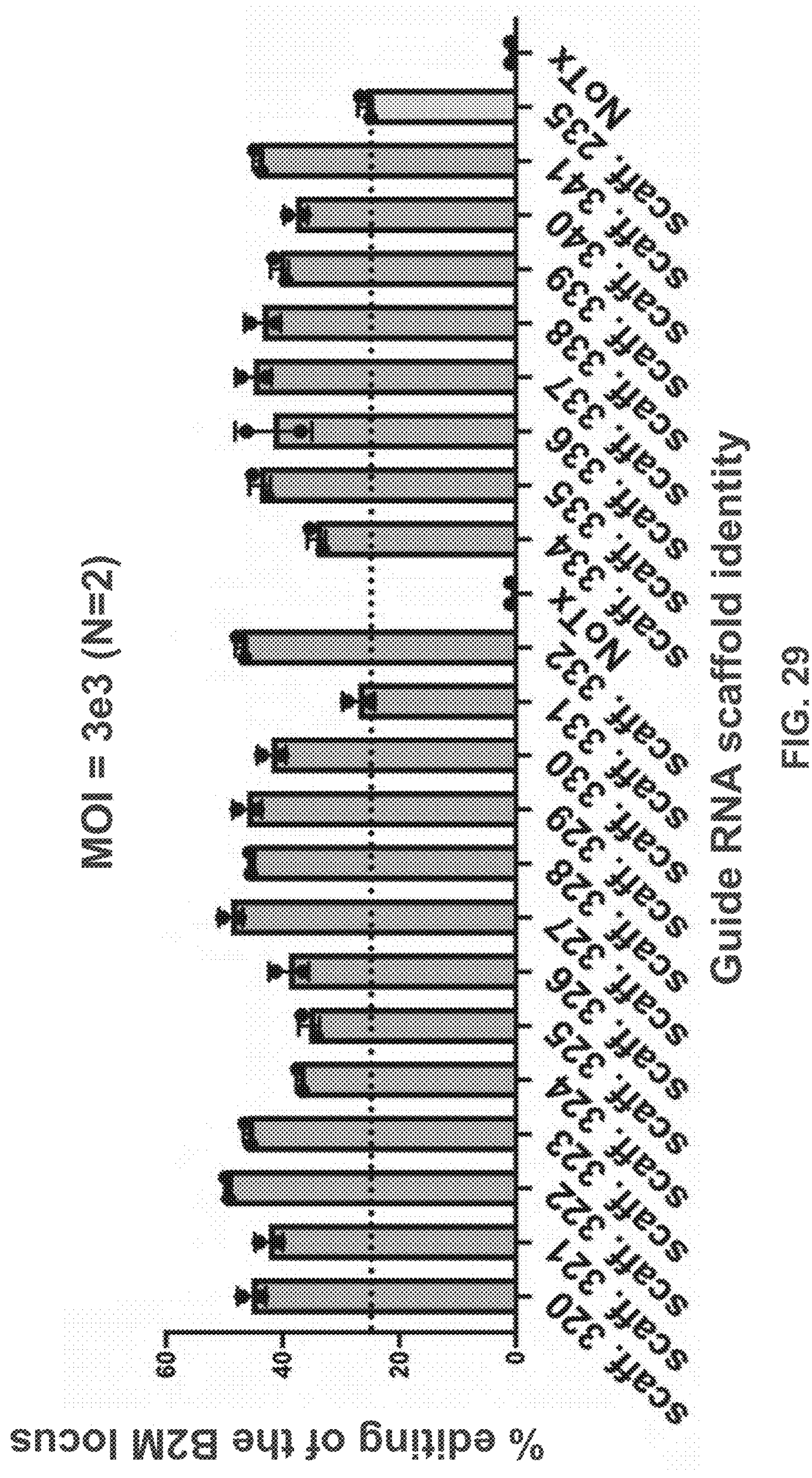
FIG. 29 provides the results of an editing experiment in which AAV vectors with various CpG-reduced or CpG-depleted guide RNA scaffolds were used to edit the B2M locus in induced neurons, as described in Example 12. The AAV vectors were administered at an MOI of 3e3. The bars show the mean±the SD of two replicates per sample. "No Tx" indicates a non-transduced control.
Figure 30:
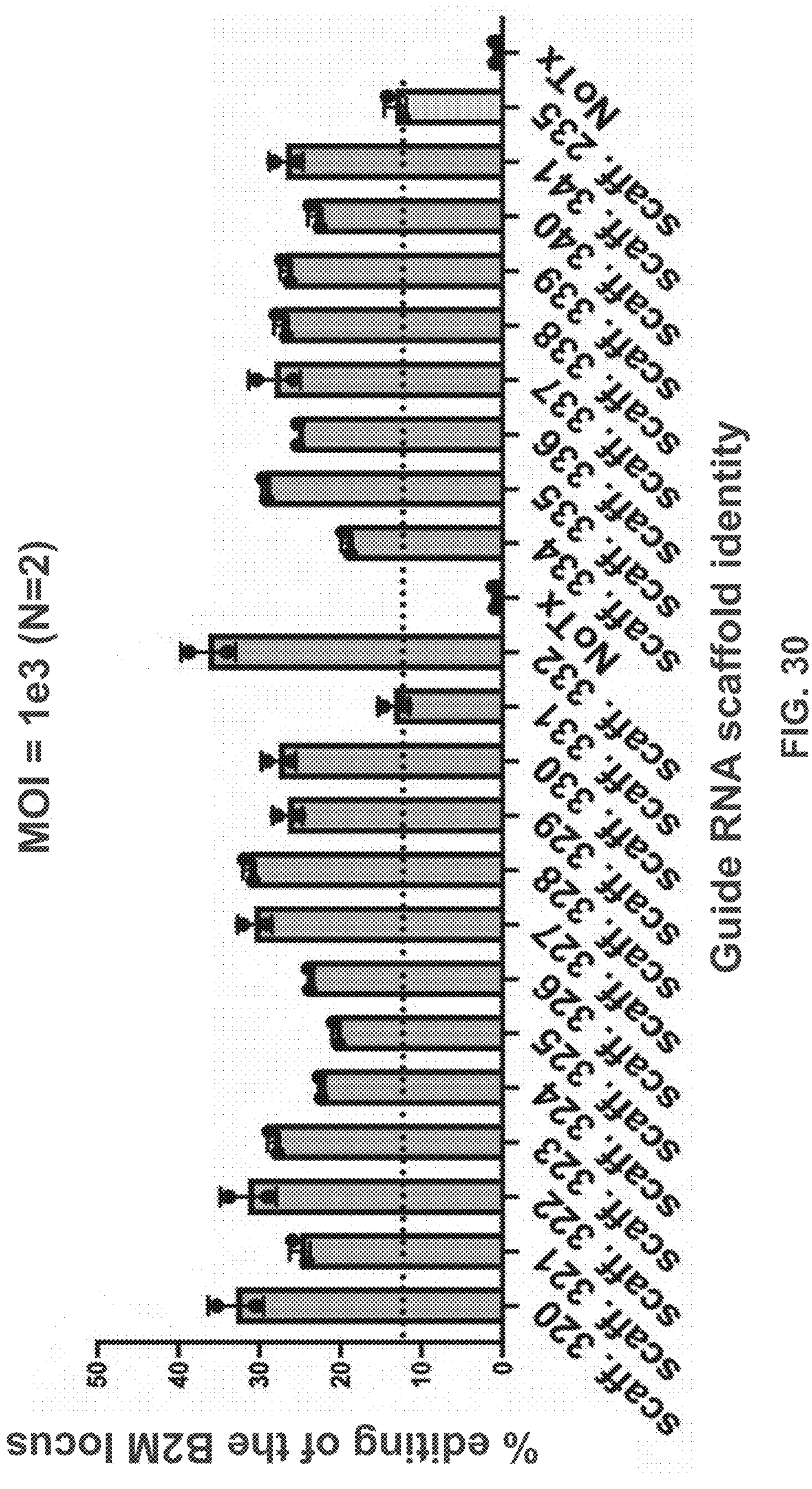
FIG. 30 provides the results of an editing experiment in which AAV vectors with various CpG-reduced or CpG-depleted guide RNA scaffolds were used to edit the B2M locus in induced neurons, as described in Example 12. The AAV vectors were administered at an MOI of 1e3. The bars show the mean±the SD of two replicates per sample. "No Tx" indicates a non-transduced control.
Figure 31:
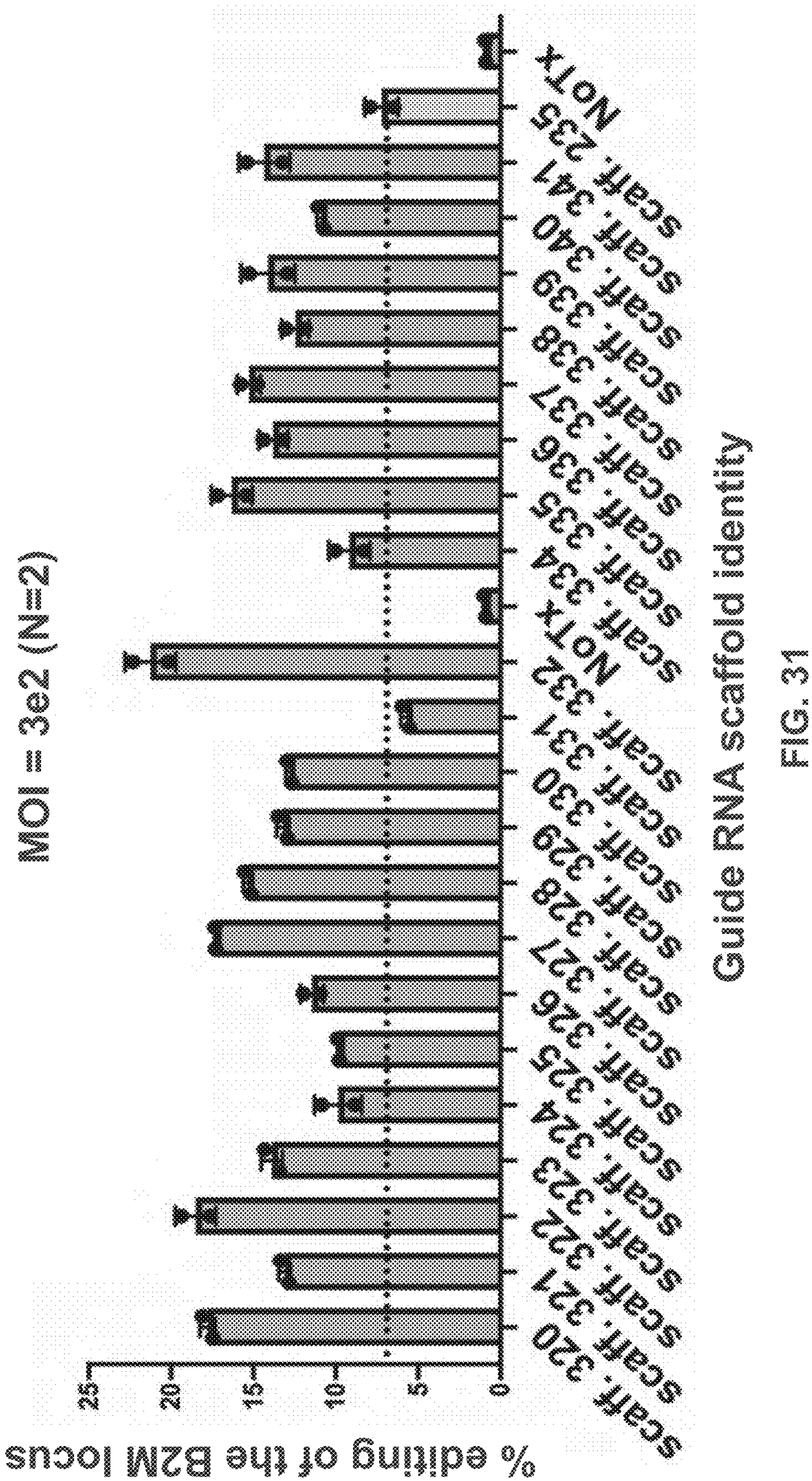
FIG. 31 provides the results of an editing experiment in which AAV vectors with various CpG-reduced or CpG-depleted guide RNA scaffolds were used to edit the B2M locus in induced neurons, as described in Example 12. The AAV vectors were administered at an MOI of MOI=3e2. The bars show the mean±the SD of two replicates per sample. "No Tx" indicates a non-transduced control.

AAV Transduction of Induced Neurons In Vitro:

24 hours prior to transduction, 50,000 induced neurons per well were seeded on Matrigel-coated 96-well plates. AAVs expressing the CasX:gRNA system with various versions of the guide scaffold were then diluted in neuronal plating media and added to cells. The first time that the experiment was performed ("N=1"), cells were transduced at a multiplicity of infection (MOI) of 4c3 viral genomes (vg)/cell (see FIG. 28). Seven days post-plating, induced neurons were transduced with virus diluted in fresh feeding media. Eight days post-transduction, cells were lifted using lysis buffer, 4-well replicates were pooled per experimental condition, and genomic DNA (gDNA) was harvested and prepared for editing analysis at the B2M locus using next generation sequencing (NGS). The second time that the experiment was performed ("N=2"), cells were transduced at an MOI of 3e3 vg/cell, 1e3 vg/cell, or 3e2 vg/cell (see FIG. 29, FIG. 30, and FIG. 31). Seven days post-plating, induced neurons were transduced with virus diluted in fresh feeding media. Seven days post-transduction, cells were lifted using lysis buffer, 2-well replicates were pooled per experimental condition, and gDNA was harvested and prepared for editing analysis at the B2M locus using NGS. Samples that were not transduced with AAV were included as controls.

NGS Processing and Analysis:

Genomic DNA (gDNA) from harvested cells were extracted using the Zymo Quick-DNA Miniprep Plus kit following the manufacturer's instructions. Target amplicons were formed by amplifying regions of interest from 200 ng of extracted gDNA with a set of primers specific to the human B2M gene. These gene-specific primers contained an additional sequence at the 5' end to introduce an Illumina adapter and a 16-nucleotide unique molecule identifier. Amplified DNA products were purified with the Ampure XP DNA cleanup kit. Quality and quantification of the amplicon were assessed using a Fragment Analyzer DNA Analysis kit (Agilent®, dsDNA 35-1500 bp). Amplicons were sequenced on the Illumina Miseq according to the manufacturer's instructions. Raw fastq files from sequencing were quality-controlled and processed using cutadapt v2.1, flash2 v2.2.00, and CRISPResso2 v2.0.29. Each sequence was quantified for containing an insertion or deletion (indel) relative to the reference sequence, in a window around the 3' end of the spacer (30 bp window centered at −3 bp from 3' end of spacer). CasX activity was quantified as the total percent of reads that contain insertions, substitutions, and/or deletions anywhere within this window for each sample.

Results

Mutations were introduced into the guide scaffold 235 in order to reduce the CpG content of the DNA sequence coding the guide scaffold. Surprisingly, compared to scaffold 235, all of the CpG-reduced and CpG-depleted scaffold variants produced higher levels of editing in induced neurons. This was the case with two independent repeats of the experiment (with the results from the first repeat of the experiment shown in FIG. 28, and the results of the second repeat of the experiment shown in FIGS. 29-31), and across multiple MOIs (see FIGS. 30-31). The enhanced level of editing was surprising because the goal of reducing CpG content was to simply preserve editing activity while reducing immunogenicity. Instead, the mutations enhanced editing activity, rather than merely preserving it.

Notably, scaffold 320 showed a significant increase in potency over scaffold 235. Scaffold 320 includes mutations to only two regions of the scaffold; in the pseudoknot stem and the extended stem (regions 1 and 4). Further, some combinations of mutations produced worse editing than scaffold 320. However, even the CpG-reduced scaffolds that performed worse than scaffold 320, such as scaffolds 331 and 334, performed similar to or better than scaffold 235.

Based on these results, without wishing to be bound by theory, it is believed that the boost in potency seen in many of the CpG-reduced and CpG-depleted scaffolds is likely caused by one of the mutations present in all CpG-reduced scaffolds (i.e., region 1 and/or 4). Since the mutation to region 4 is not present in the scaffolds with the extended stem loop replacement (i.e., the third mutation to region 3) and these scaffolds show a similar improvement in potency over 235 as 320 did, it is believed that the beneficial effect is likely caused by the mutation in region 1 (pseudoknot stem), which is present in all of the tested scaffolds. Further experiments will be performed to test the effect of the individual mutations in the pseudoknot stem (region 1) and the extended stem (region 4) separately.

Figure 28:
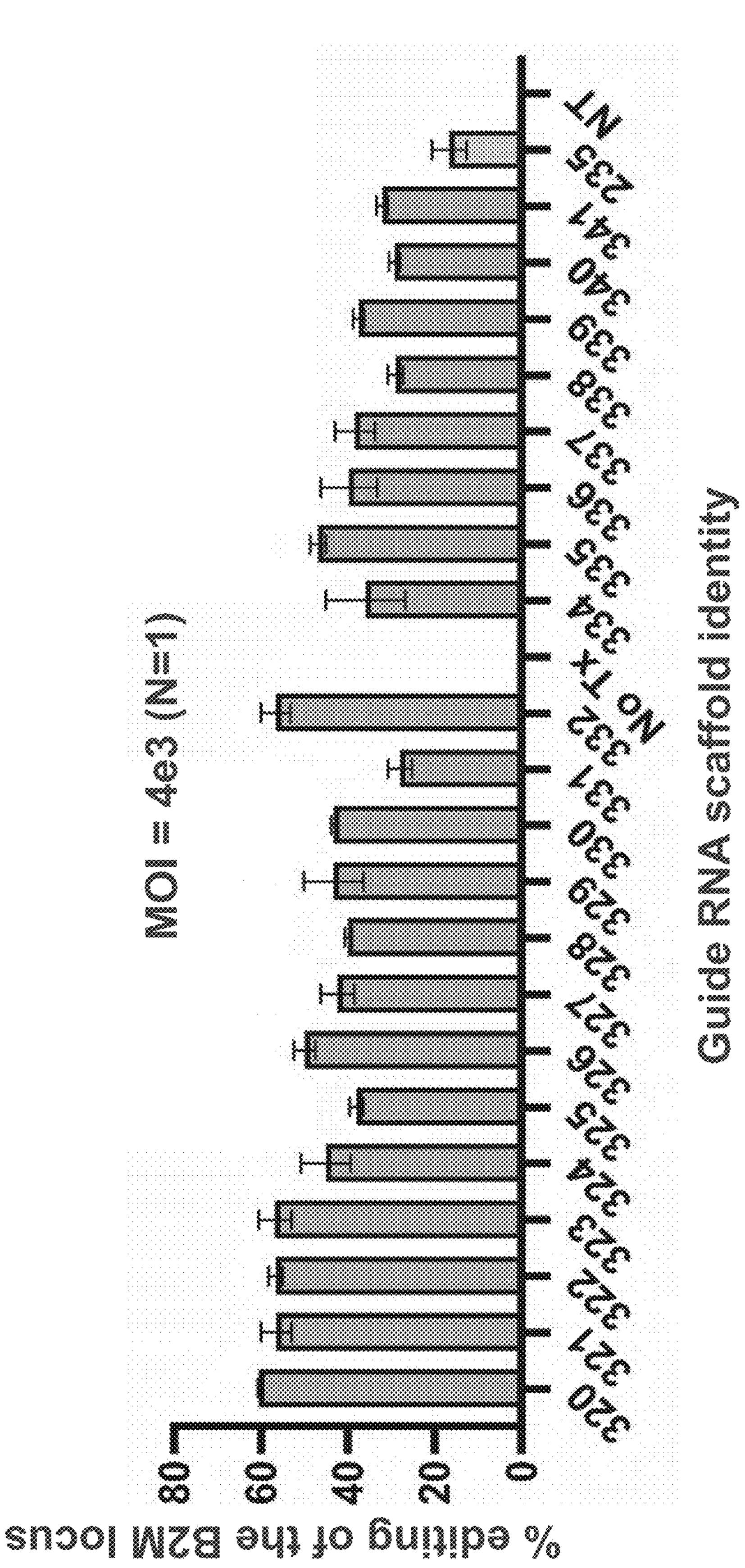
FIG. 28 provides the results of an editing experiment in which AAV vectors with various CpG-reduced or CpG-depleted guide RNA scaffolds were used to edit the B2M locus in induced neurons, as described in Example 12. The AAV vectors were administered at a multiplicity of infection (MOI) of 4e3. The bars show the mean±the SD of two replicates per sample. "No Tx" indicates a non-transduced control, and "NT" indicates a control with a non-targeting spacer.

Further, the N=1 data as presented in FIG. 28 indicate that all the new scaffolds carrying the mutation in region 2 (scaffold stem) edited at a slightly lower level than their respective counterparts without this mutation. This suggests that mutating this position in the scaffold stem may have a small deleterious effect on editing potency. This will be examined in additional experiments.

The results described here demonstrate that introducing mutations that reduced the CpG content of the DNA encoding the guide RNA scaffold resulted in improvements in gene editing relative to guide scaffold 235.

Example 13: Use of a Catalytically-Dead CasX Repressor System Fused with Additional Domains From DNMT3A and DNMT3L to Induce Durable Silencing of the B2M Locus Experiments were performed to determine whether rationally-designed LTRP constructs, with three repressor domains composed of a transcriptional repressor domain, the catalytic domain from DNMT3A and the interaction domain from DNMT3L fused to catalytically-dead CasX (dCasX) 491, would induce durable long-term repression of the endogenous B2M locus in vitro. In addition, multiple configurations of the LTRP molecules, which contain varying placements of the epigenetic domains relative to dCasX, were designed to assess how their arrangement would affect the duration of silencing of the B2M locus, as well as the specificity of their on-target methylation activity.

Materials and Methods

Generation of LTRP Constructs and Lentiviral Plasmid Cloning:

Lentiviral plasmid constructs coding for an LTRP molecule were built using standard molecular cloning techniques. These constructs comprised of sequences coding for catalytically-dead CasX protein 491 (dCasX491), a KRAB domain from ZNF10 or ZIM3, and the catalytic domain and interaction domain from DNMT3A (D3A) and DNMT3L (D3L) respectively. Briefly, constructs were ordered as oligonucleotides and assembled by overlap extension PCR followed by isothermal assembly. Amino acid sequences of these key LTRP elements are provided in Table 44. The resulting plasmids contained constructs positioned in varying configurations to generate an LTRP molecule. The protein sequences for the LTRP molecules are listed in Table 45, and the LTRP configurations are illustrated in FIG. 1. Sequences encoding the LTRP molecules also contained a 2×FLAG tag. Plasmids also harbored sequences encoding gRNA scaffold variant 174 having either a spacer targeting the endogenous B2M locus or a non-targeting control (spacer sequences listed in Table 46). These constructs were all cloned upstream of a P2A-puromycin element on the lentiviral plasmid. Cloned and sequence-validated constructs were midi-prepped and subjected to quality assessment prior to transfection in HEK293T cells.

TABLE 44

Sequences of LTRP components (e.g., additional domains fused to CasX) to generate LTRP variant plasmids (illustrated in FIG. 1)

| Component | SEQ ID NO |
|---|---|
| ZNF10 KRAB domain | 3239 |
| ZIM3 KRAB domain | 3240 |
| DNMT3A catalytic domain | 3241 |
| DNMT3L interaction domain | 127 |
| dCasX491 | 4 |
| Linker 1 | 123 |
| Linker 2 | 122 |
| Linker 3A | 120 |
| Linker 3B | |
| Linker 4 | 121 |
| NLS A | 30 |

TABLE 45

Protein sequences of LTRP molecules

| LTRP ID | SEQ ID NO |
|---|---|
| 1.A | 3242 |
| 1.B | 3243 |
| 2.A | 3244 |
| 2.B | 3245 |
| 3.A | 3246 |
| 3.B | 3247 |
| 4.A | 3248 |
| 4.B | 3249 |
| 5.A | 3250 |
| 5.B | 3251 |

TABLE 46

| Spacer ID | Target gene | PAM | Sequence | SEQ ID NO |
|---|---|---|---|---|
| 7.37 | B2M | TTC | GGCCGAGAUGUCUCGCUCCG | 3137 |
| 7.148 | B2M | NGG | CGCGAGCACAGCUAAGGCCA | 3101 |
| 0.0 | Non-target | N/A | CGAGACGUAAUUACGUCUCG | 3232 |

Sequences of spacers used in constructs

Transfection of HEK293T Cells:

HEK293T cells were seeded at a density of 30,000 cells in each well of a 96-well plate. The next day, each well was transiently transfected using Lipofectamine™ with 100 ng of LTRP variant plasmids, each containing a construct encoding for a differently configured LTRP protein (FIG. 1), with the gRNA having either non-targeting spacer 0.0 or targeting spacer 7.37 to the B2M locus. Specifically, for one experiment, HEK293T cells were transfected with plasmids encoding LTRP proteins #1-3, and in a second experiment, cells were lipofected with plasmids encoding LTRP protein #1, 4, and 5. In both experiments, LTRP molecules harbored a KRAB domain either from ZNF10 or ZIM3. Experimental controls included dCasX491 (with or without the ZNF10 repressor domain), catalytically-active CasX 491, and a catalytically-dead Cas9 fused to both the ZNF10-KRAB domain and DNMT3A/L domains, each with the same B2M-targeting or non-targeting gRNA. Each construct was tested in triplicate. 24 hours post-transfection, cells were selected with 1 ug/mL puromycin for two days. Starting six days after transfection, cells were harvested for repression analysis every 2-3 days by analyzing B2M protein expression via HLA immunostaining followed by flow cytometry. B2M expression was determined by using an antibody that would detect the B2M-dependent HLA protein expressed on the cell surface. HLA+ cells were measured using the Attune™ NxT flow cytometer. In addition, in a separate experiment, HEK293T cells transiently transfected with LTRP variant plasmids and the B2M-targeting gRNA or non-targeting gRNA were harvested at five days post-lipofection for genomic DNA (gDNA) extraction for bisulfite sequencing.

Bisulfite Sequencing to Assess LTRP Specificity Measured by Off-Target Methylation Levels at Target Locus:

To determine off-target methylation levels at the B2M locus, gDNA from harvested cells was extracted using the Zymo Quick-DNA Miniprep Plus kit following the manufacturer's instructions. The extracted gDNA was then subjected to bisulfite conversion using the EZ DNA Methylation™ Kit (Zymo) following the manufacturer's protocol, converting any non-methylated cytosine into uracil. The resulting bisulfite-treated DNA was subsequently sequenced using next-generation sequencing (NGS) to determine the levels of off-target methylation at the B2M and VEGFA loci.

NGS Processing and Analysis:

Target amplicons were amplified from 100 ng bisulfite-treated DNA via PCR with a set of primers specific to the bisulfite-converted target locations of interest (human B2M and VEGFA loci). These gene-specific primers contained an additional sequence at the 5' end to introduce an Illumina™ adapter. Amplified DNA products were purified with the Cytiva™ Sera-Mag Select™ DNA cleanup kit. Quality and quantification of the amplicon were assessed using a Fragment Analyzer DNA Analysis kit (Agilent®, dsDNA 35-1500 bp). Amplicons were sequenced on the Illumina™ Miseq™ according to the manufacturer's instructions. Raw fastq files from sequencing were processed using Bismark Bisulfite Read Mapper and Methylation caller. PCR amplification of the bisulfite-treated DNA would convert all uracil nucleotides into thymine, and sequencing of the PCR product would determine the rate of cytosine-to-thymine conversion as a readout of the level of potential off-target methylation at the B2M and VEGFA loci mediated by each LTRP molecule.

Results

Figure 32A:
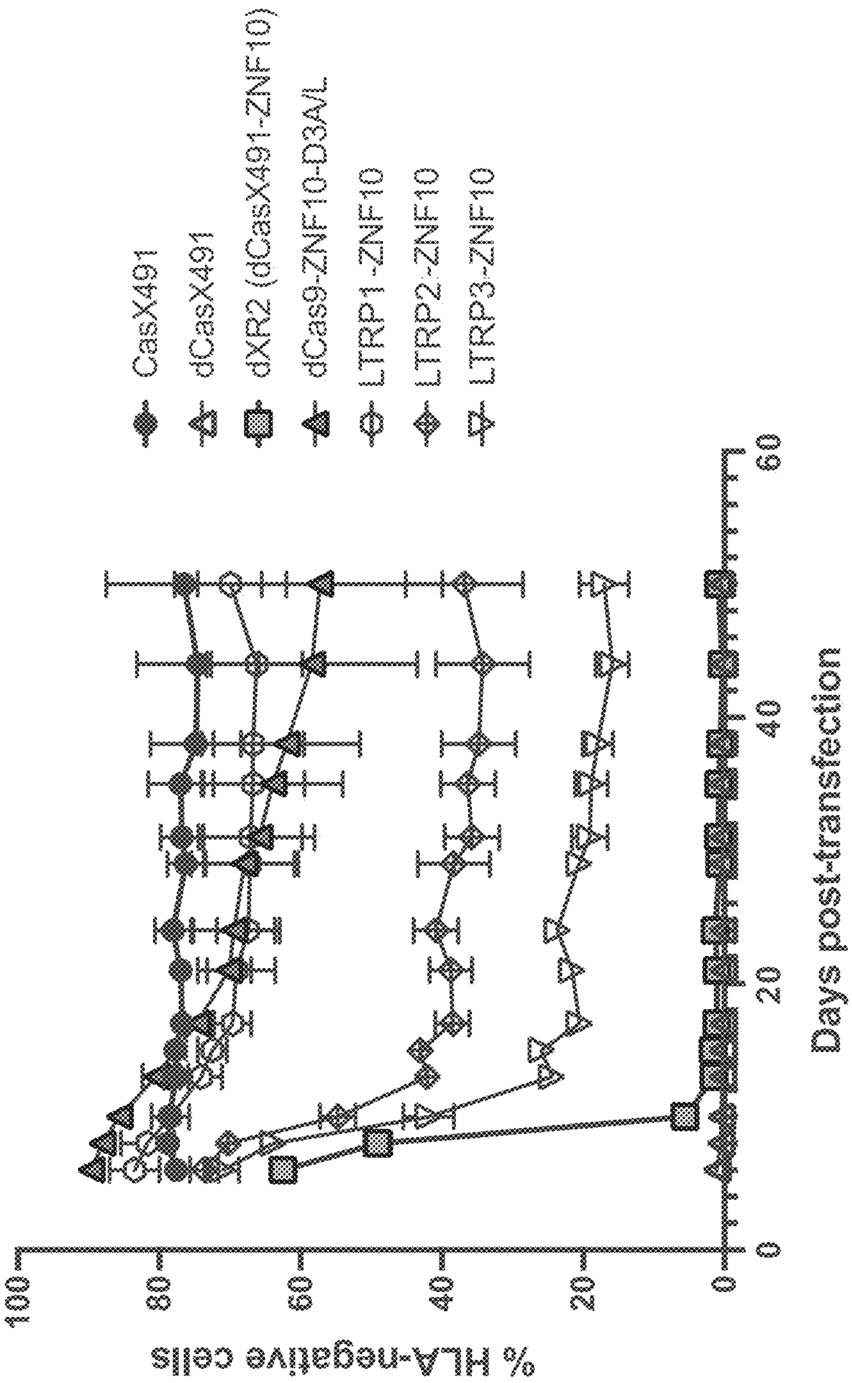
FIG. 32A presents the results of a time-course experiment comparing beta-2-microglobulin (B2M) repression activities (represented as percentage of HLA-negative cells) of LTRP proteins Nos. 1-3, as described in Example 13. Data are presented as mean with standard deviation, N=3.
Figure 32B:
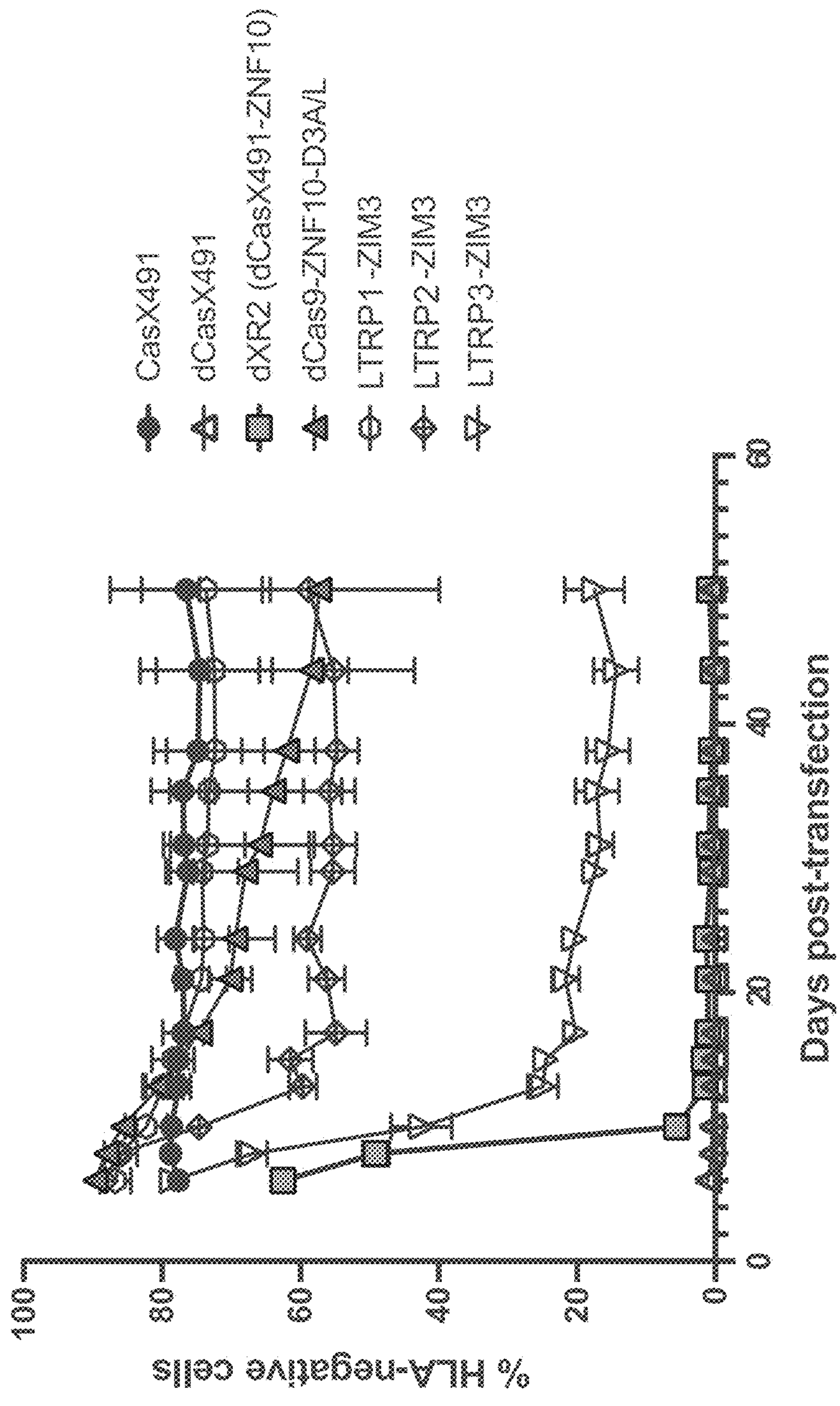
FIG. 32B presents the results of the same time-course experiment shown in FIG. 32A but illustrates the B2M repression activities of LTRP proteins Nos. 1-3 containing the ZIM3-KRAB domain, benchmarked against the same experimental controls, as described in Example 13. Data are presented as mean with standard deviation, N=3.

LTRP variant plasmids encoding for differently configured LTRP proteins (FIG. 1) were transiently transfected into HEK293T cells to determine whether the rationally-designed LTRP molecules could heritably silence gene expression of the target B2M locus in vitro. FIGS. 32A and 32B depict the results of a time-course experiment assessing B2M protein repression mediated by LTRP proteins #1-3, each of which harbored a KRAB domain from ZNF10 (FIG. 32A) or ZIM3 (FIG. 32B). Table 47 shows the average percentage of cells characterized as HLA-negative (indicative of depleted B2M expression) for each condition at 50 days post-transfection. The results illustrate that all LTRP molecules with a gRNA targeting the B2M locus were able to demonstrate sustained B2M repression for 50 days in vitro, although the potency of repression varied by the choice of KRAB domain and LTRP configuration. For instance, harboring a ZIM3-KRAB domain rendered the LTRP protein a more efficacious repressor than harboring a ZNF10-KRAB, and this effect was most prominently observed for LTRP #2 (compare FIG. 32A to FIG. 32B). Furthermore, positioning the DNMT3A/L domains at the N-terminus of dCasX491 (LTRP #1) resulted in more stable silencing of B2M expression compared to effects mediated by LTRPs with DNMT3A/L domains at the C-terminus of dCasX491 (LTRP #2 and #3; FIGS. 32A and 32B). These results also revealed that the relative positioning of the two types of repressor domains (i.e., dCasX491-KRAB-DNMT3A/L for LTRP #2 vs. dCasX491-DNMT3A/L-KRAB for LTRP #3) could also influence the overall potency of the LTRP molecule, despite both configurations being C-terminal fusions of dCasX491 (LTRP #2 and #3; FIGS. 32A and 32B).

Figure 33A:
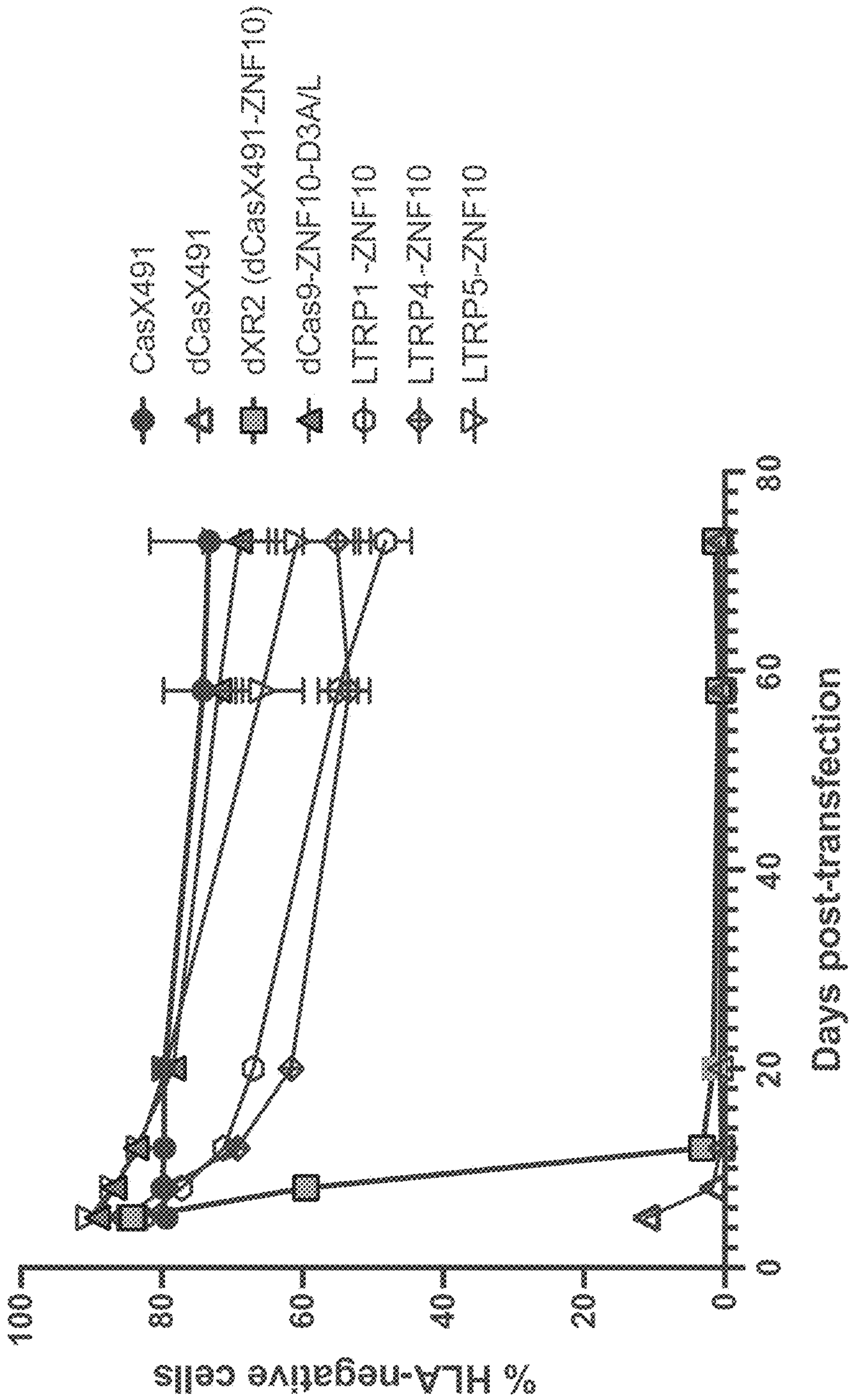
FIG. 33A presents the results of a time-course experiment comparing B2M silencing activities (represented as percentage of HLA-negative cells) of LTRP proteins #1, #4, and #5, as described in Example 13. Data are presented as mean with standard deviation, N=3.
Figure 33B:
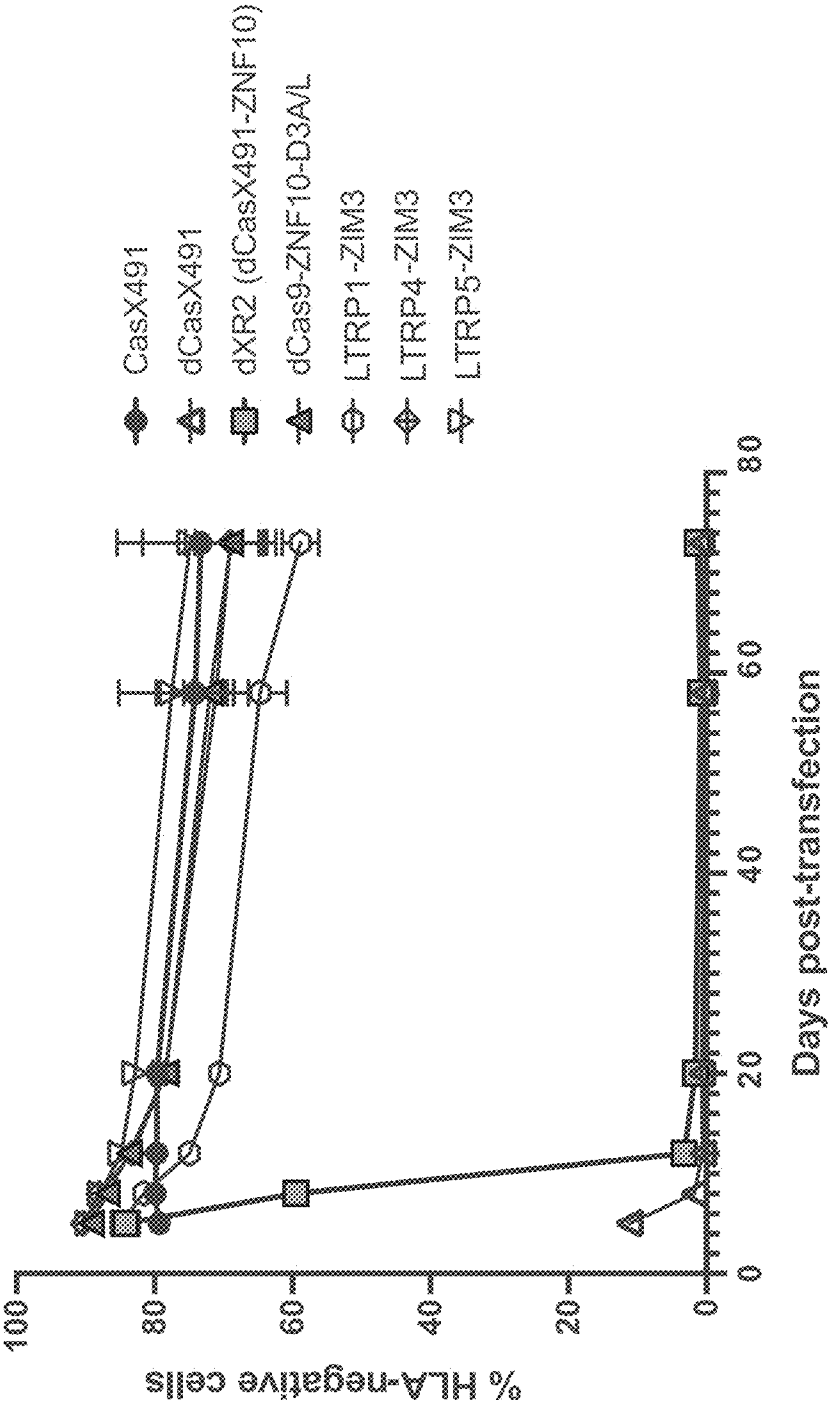
FIG. 33B presents the results of the same time-course experiment shown in FIG. 33A but illustrates the B2M silencing activities of LTRP proteins #1, #4, and #5 containing the ZIM3-KRAB domain, benchmarked against the same experimental controls, as described in Example 13. Data are presented as mean with standard deviation, N=3.

In a second time-course experiment, durable B2M repression was assessed for LTRP proteins #1, #4, and #5, where both the DNMT3A/L and KRAB domains were positioned at the N-terminus of dCasX491 for LTRP #4 and #5 (FIG. 1). Table 48 shows the average percentage of HLA-negative cells for each condition at 73 days post-lipofection. As similarly seen in the first time-course, all LTRP conditions with a B2M-targeting gRNA maintained durable silencing of the B2M locus (FIGS. 33A and 33B; Table 48). In fact, the results in this experiment demonstrate that LTRP #5 was able to achieve and sustain the highest level of B2M repression compared to that achieved by LTRP #1 or LTRP #4 for 73 days in vitro (FIGS. 33A and 33B). Furthermore, LTRP #4 containing the ZIM3-KRAB also appeared to outperform its LTRP #1 counterpart (FIG. 33B). For both time-course experiments discussed above, CasX 491-mediated editing resulted in durable silencing of the B2M expression, while an XR construct fusing only the KRAB domain to dCasX491 (dCasX491-ZNF10) only resulted in transient B2M knockdown.

TABLE 47

Levels of B2M repression mediated by CasX and Cas9 molecules and LTRP constructs #1-3 quantified at 50 days post-transfection

| Molecule | Spacer | % HLA-negative cells (mean) | Standard deviation |
|---|---|---|---|
| CasX 491 | 0.0 | 0.29 | 0.09 |
| dCasX491 | 0.0 | N/A | N/A |
| dCasX491-ZNF10 | 0.0 | 0.40 | 0.18 |
| dCas9-ZNF10-D3A/L | 0.0 | 1.05 | 0.63 |
| LTRP1-ZNF10 | 0.0 | 0.99 | 0.35 |
| LTRP2-ZNF10 | 0.0 | 0.61 | 0.11 |
| LTRP3-ZNF10 | 0.0 | 0.79 | 0.29 |
| LTRP1-ZIM3 | 0.0 | 0.99 | 0.22 |
| LTRP2-ZIM3 | 0.0 | 0.78 | 0.27 |
| LTRP3-ZIM3 | 0.0 | 0.71 | 0.53 |
| CasX 491 | 7.37 | 76.57 | 11.03 |
| dCasX491 | 7.37 | 0.49 | 0.10 |
| dCasX491-ZNF10 | 7.148 | 0.89 | 0.19 |
| dCas9-ZNF10-D3A/L | 7.148 | 57.30 | 17.36 |
| LTRP1-ZNF10 (LTRP #1.B) | 7.37 | 69.97 | 7.89 |
| LTRP2-ZNF10 (LTRP #2.B) | 7.37 | 36.87 | 8.31 |
| LTRP3-ZNF10 (LTRP #3.B) | 7.37 | 17.07 | 3.50 |
| LTRP1-ZIM3 (LTRP #1.A) | 7.37 | 73.70 | 9.28 |
| LTRP2-ZIM3 (LTRP #2.A) | 7.37 | 58.83 | 0.87 |
| LTRP3-ZIM3 (LTRP #3.A) | 7.37 | 17.50 | 4.30 |

TABLE 48

Levels of B2M repression mediated by CasX and Cas9 molecules and LTRP constructs #1, #4, and #5 quantified at 73 days post-transfection

| Molecule | Spacer | % HLA-negative cells (mean) | Standard deviation |
|---|---|---|---|
| CasX 491 | 0.0 | 0.71 | 0.05 |
| dCasX491 | 0.0 | N/A | N/A |
| dCasX491-ZNF10 | 0.0 | 0.76 | 0.12 |
| dCas9-ZNF10-D3A/L | 0.0 | 0.83 | 0.08 |
| LTRP1-ZNF10 | 0.0 | 1.04 | 0.44 |
| LTRP4-ZNF10 | 0.0 | 1.17 | 0.52 |
| LTRP5-ZNF10 | 0.0 | 1.94 | 1.27 |
| LTRP1-ZIM3 | 0.0 | 1.83 | 0.76 |
| LTRP4-ZIM3 | 0.0 | N/A | N/A |
| LTRP5-ZIM3 | 0.0 | 1.15 | 0.26 |
| CasX 491 | 7.37 | 73.30 | 8.43 |
| dCasX491 | 7.37 | 0.83 | 0.16 |
| dCasX491-ZNF10 | 7.148 | 1.37 | 0.37 |
| dCas9-ZNF10-D3A/L | 7.148 | 68.97 | 5.21 |
| LTRP1-ZNF10 (LTRP #1.B) | 7.37 | 48.27 | 3.66 |
| LTRP4-ZNF10 (LTRP #4.B) | 7.37 | 55.17 | 4.83 |
| LTRP5-ZNF10 (LTRP #5.B) | 7.37 | 60.77 | 8.12 |
| LTRP1-ZIM3 (LTRP #1.A) | 7.37 | 58.90 | 2.69 |
| LTRP4-ZIM3 (LTRP #4.A) | 7.37 | 69.00 | 6.58 |
| LTRP5-ZIM3 (LTRP #5.A) | 7.37 | 74.90 | 10.61 |

Figure 34:
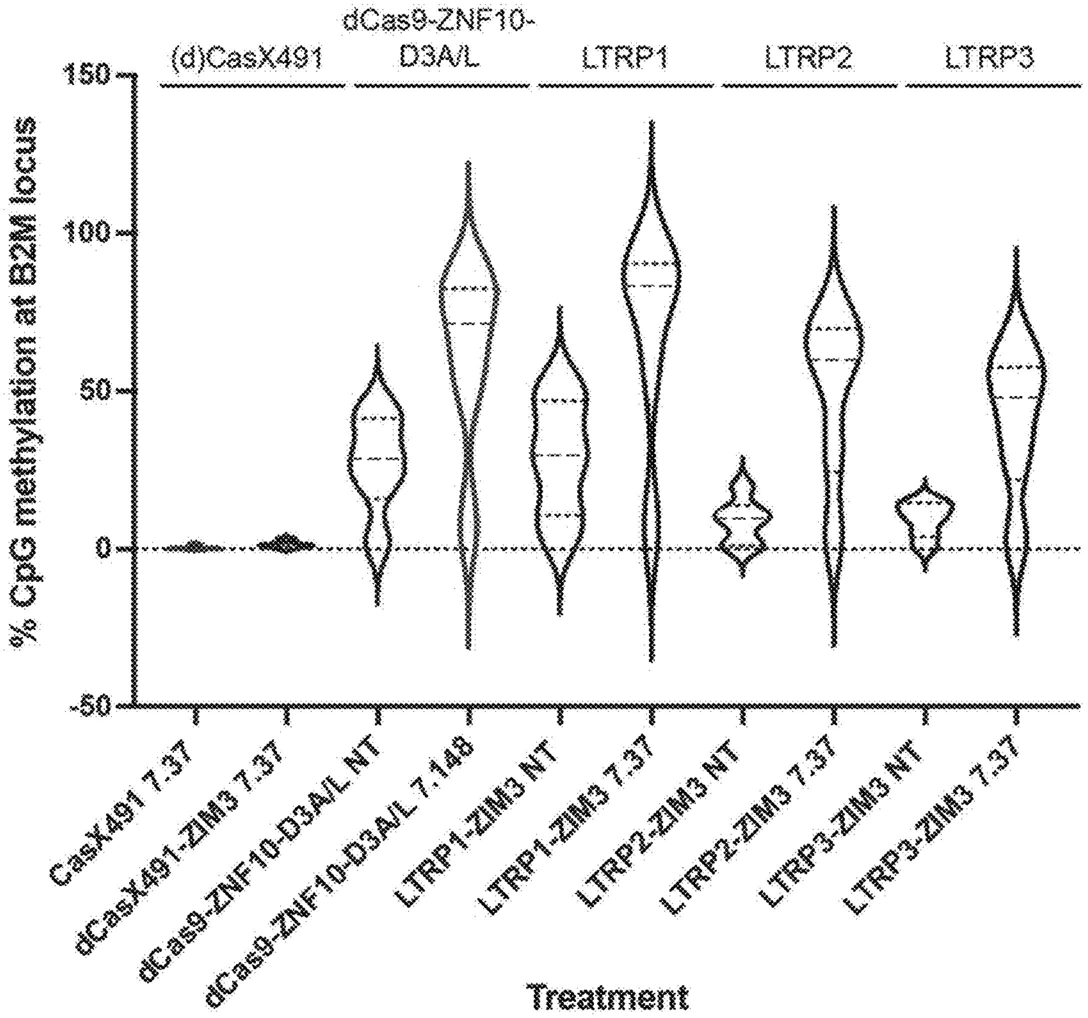
FIG. 34 is a violin plot of percent CpG methylation for CpG sites around the transcription start site of the B2M locus for each indicated experimental condition as described in Example 13.
Figure 35:
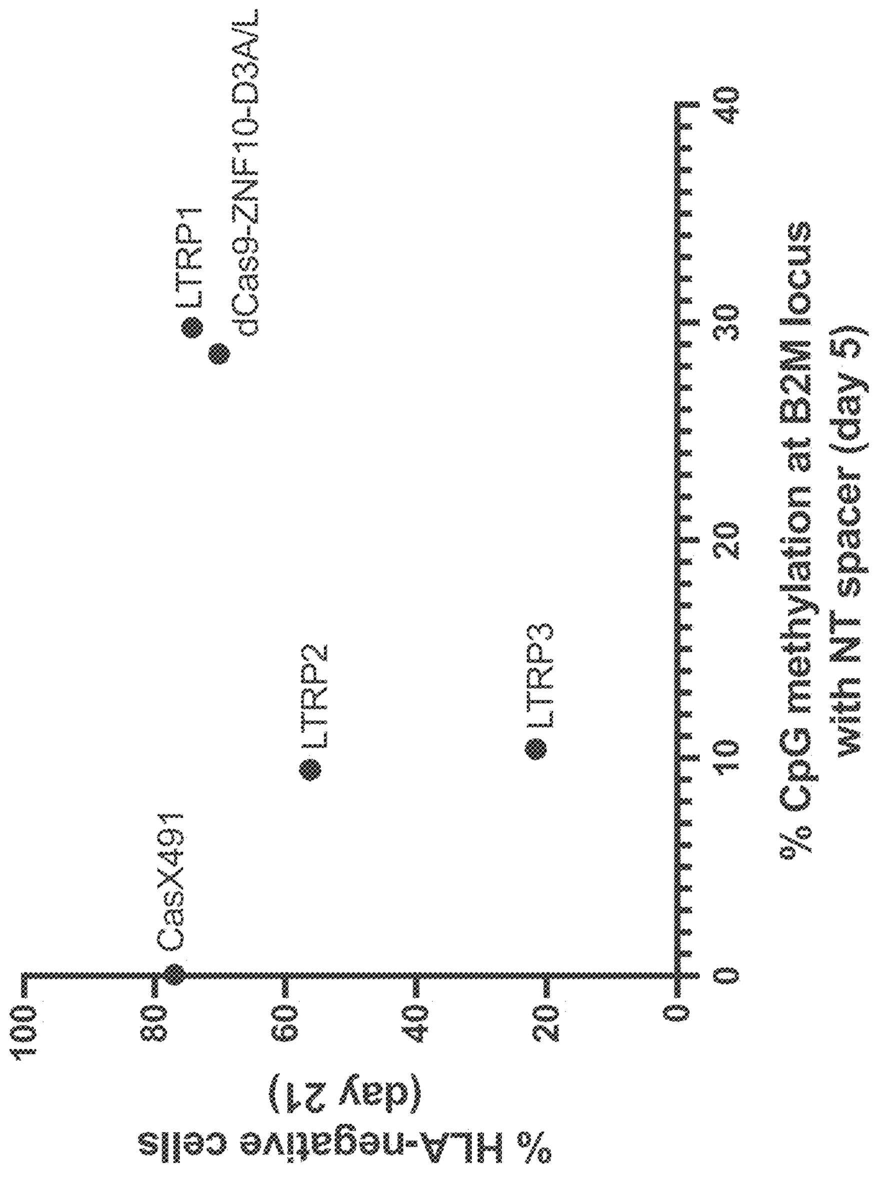
FIG. 35 is a dot plot showing the relative activity (average percentage of HLA-negative cells at day 21) versus specificity (percentage of off-target CpG methylation at the B2M locus quantified at day 5) for LTRP proteins #1-3, benchmarked against catalytically-active CasX 491 and dCas9-ZNF10-DNMT3A/L, as described in Example 13.

To evaluate the degree of off-target CpG methylation at the B2M locus mediated by the DNMT3A/L domains within the LTRP molecules, bisulfite sequencing was performed using genomic DNA extracted from HEK293T cells treated with LTRP proteins #1-3 containing the ZIM3-KRAB domain and harvested at five days post-lipofection. FIG. 34 illustrates the findings from bisulfite sequencing, specifically showing the distribution of the number of CpG sites around the transcription start site of the B2M locus that harbored a certain level of CpG methylation for each experimental condition. The results revealed that while LTRP #1 demonstrated the strongest on-target CpG-methylating activity (LTRP1-ZIM3 7.37), it induced the highest level of off-target CpG methylation (LTRP1-ZIM3 NT). LTRP #2 and LTRP #3 displayed weaker on-target CpG-methylating activity but relatively lower off-target methylation (FIG. 34). FIG. 35 is a scatterplot mapping the activity-specificity profiles for LTRP proteins #1-3 benchmarked against CasX 491 and dCas9-ZNF10-DNMT3A/L, where activity was measured as the average percentage of HLA-negative cells at day 21, and specificity was represented by the percentage of off-target CpG methylation at the B2M locus quantified at day 5.

Figure 36:
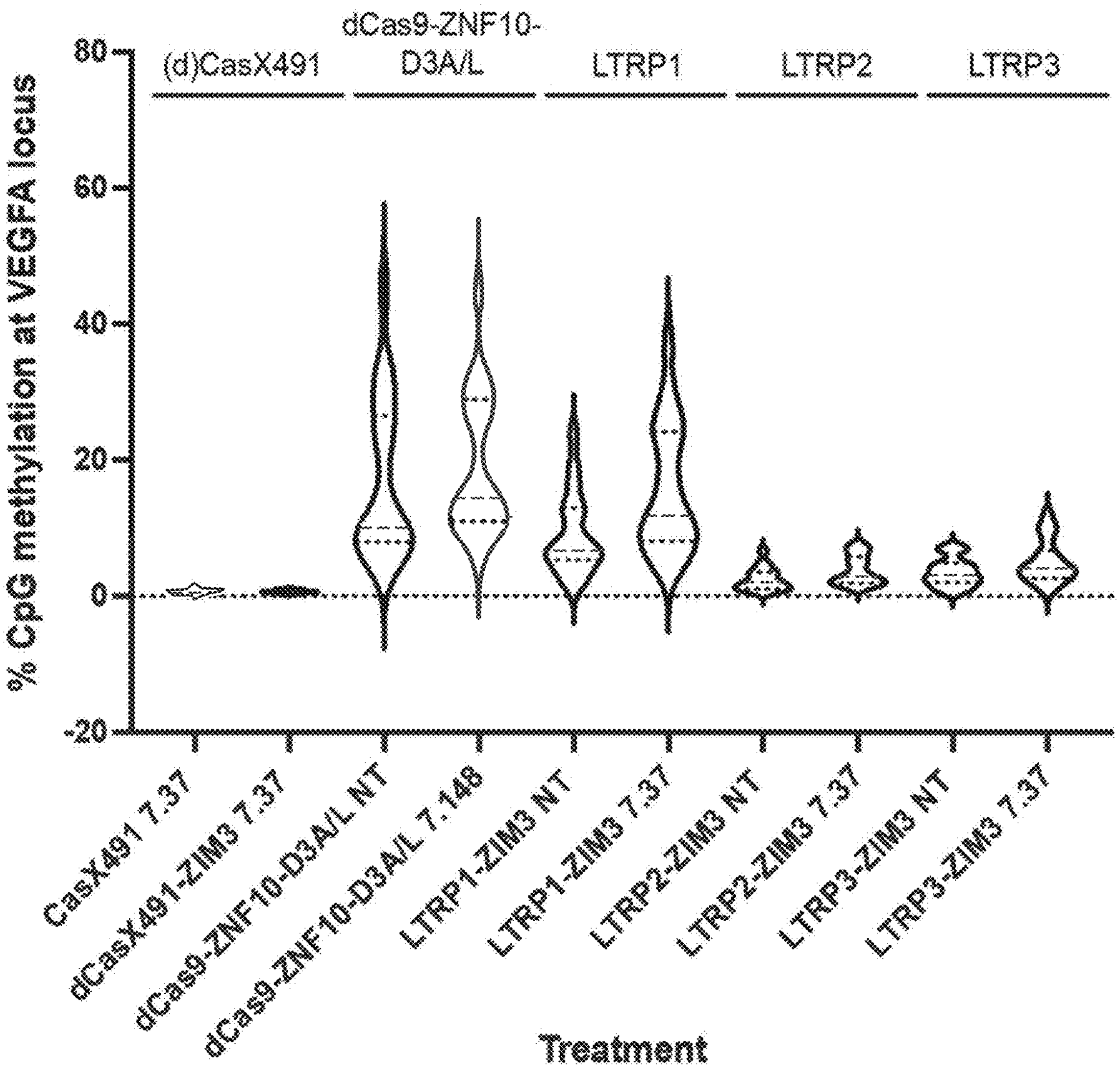
FIG. 36 is a violin plot of percent CpG methylation for CpG sites downstream of the transcription start site of the VEGFA locus for each indicated experimental condition as described in Example 13.

The degree of off-target CpG methylation mediated by the DNMT3A/L domain was further evaluated by assessing the level of CpG methylation at a different locus, i.e., VEGFA, by performing bisulfite sequencing using the same extracted gDNA as was used previously for FIG. 34. The violin plot in FIG. 36 illustrates the bisulfite sequencing results showing the distribution of CpG sites with CpG methylation at the VEGFA locus in cells treated with LTRP proteins #1-3 containing the ZIM3-KRAB domain and a B2M-targeting gRNA. The findings further demonstrate that use of LTRP #1 resulted in the highest level of off-target CpG methylation, supporting the data shown earlier in FIG. 34. In comparison, use of either LTRP #2 or LTRP #3 resulted in substantially lower off-target methylation at the −3 locus (FIG. 36).

Figure 37B:
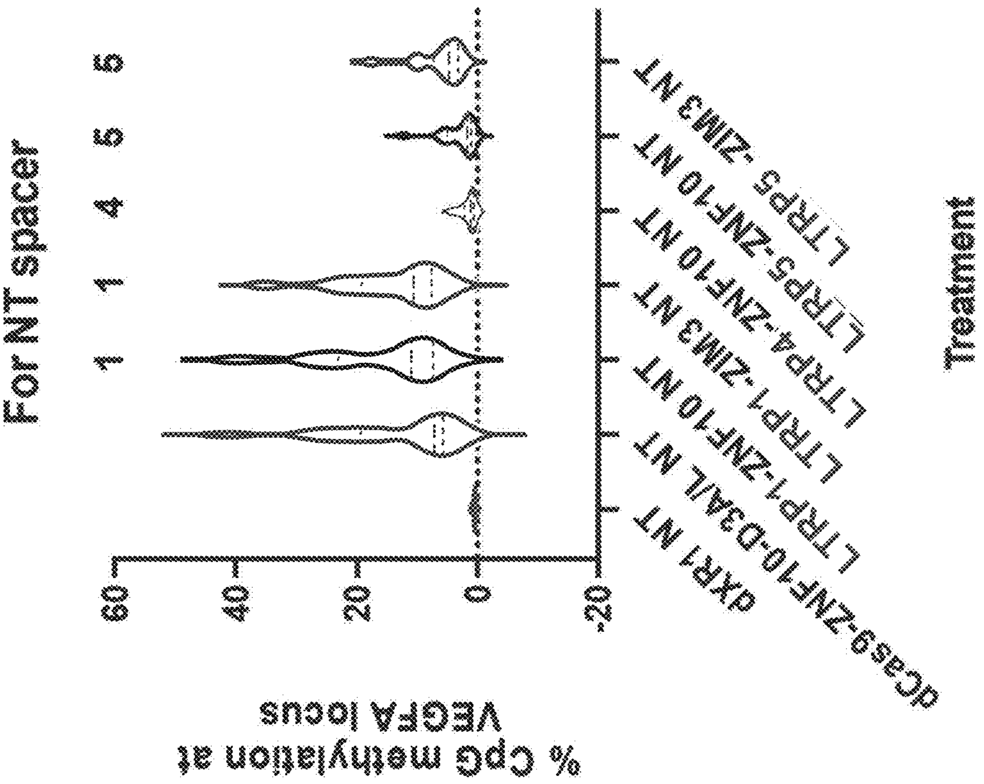
FIG. 37B is a violin plot of percent CpG methylation for CpG sites around the transcription start site of the VEGFA locus for each indicated experimental condition assessing LTRP #1, 4, and 5 with the non-targeting spacer as described in Example 13.
Figure 37A:
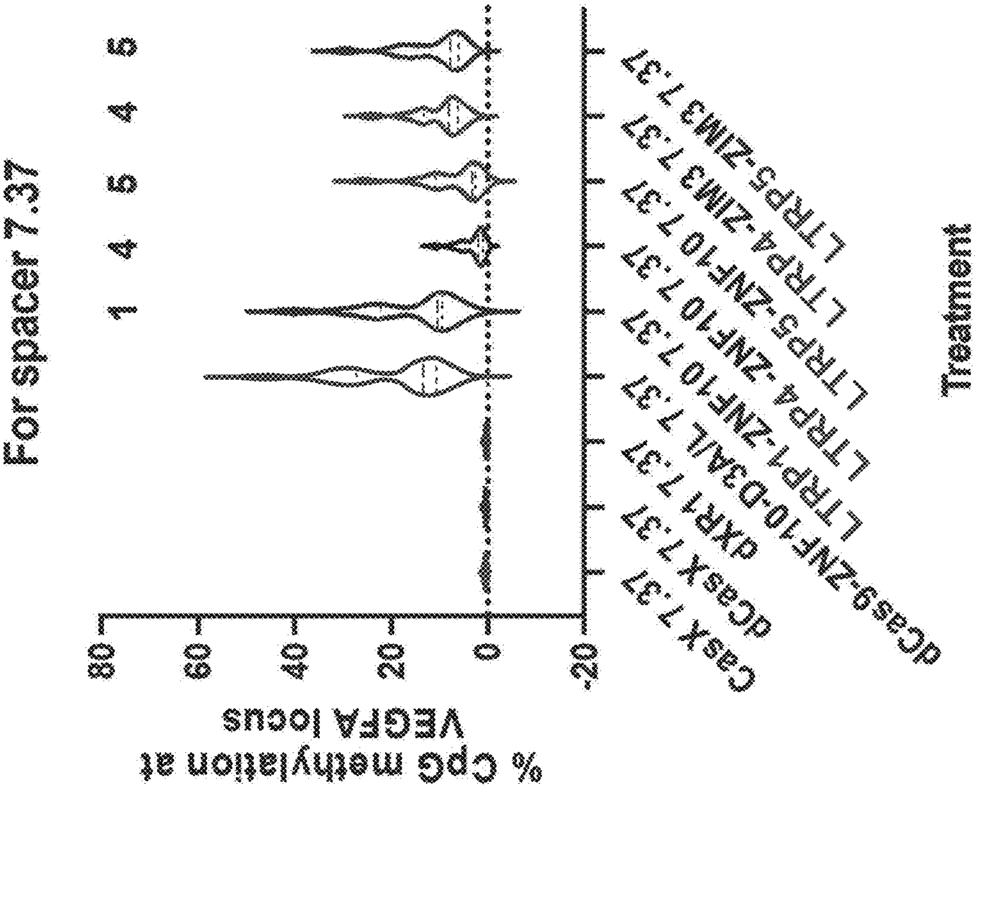
FIG. 37A is a violin plot of percent CpG methylation for CpG sites around the transcription start site of the VEGFA locus for each indicated experimental condition assessing LTRP #1, 4, and 5 with the B2M-targeting spacer as described in Example 13.

The extent of off-target CpG methylation at the VEGFA locus for LTRP molecules #1, #4, and #5 was also analyzed. The plots in FIG. 37A-37B illustrate bisulfite sequencing results showing the distribution of CpG-methylated sites at the VEGFA locus in cells treated with LTRP #1, 4, and 5 containing a ZNF10 or ZIM3-KRAB domain and either a non-targeting gRNA (FIG. 37B) or a B2M-targeting gRNA (FIG. 37A). The data in FIG. 37B show that use of LTRP4-ZNF10, LTRP5-ZFN10, or LTRP5-ZIM3 resulted in markedly lower off-target CpG methylation at the VEGFA locus in comparison to use of LTRP1-ZNF10 or LTRP1-ZIM3. Similarly, the data in FIG. 37A show that use of LTRP #4 or LTRP #5 with either KRAB domain resulted in substantially lower levels of off-target CpG methylated sites compared to use with LTRP1-ZNF10. As exhibited in both FIGS. 37A and 37B, the level of non-specific CpG methylation demonstrated by LTRP #1 is comparable to that achieved by the dCas9-ZNF10-DNMT3A/L benchmark.

Figure 38:
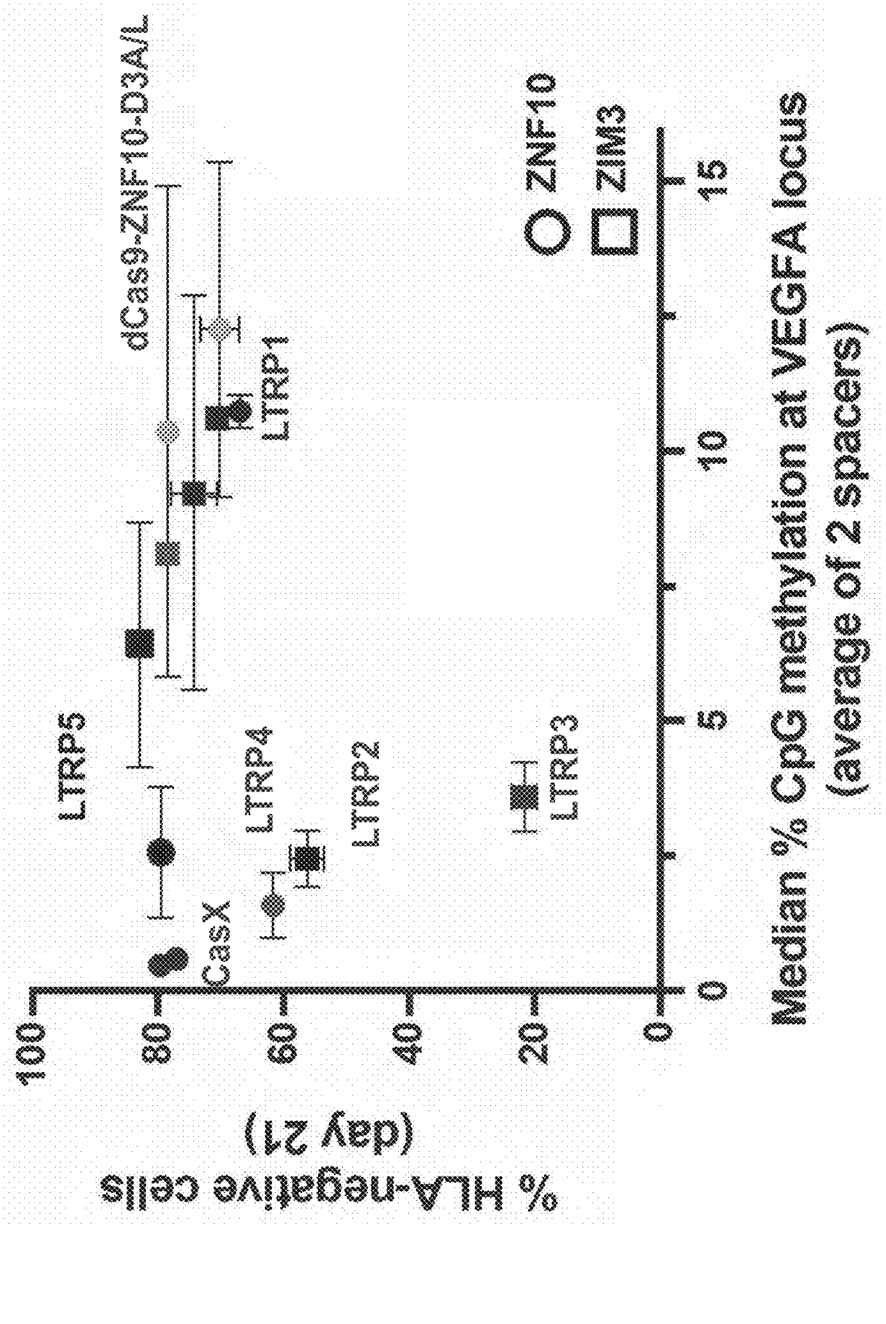
FIG. 38 is a scatterplot showing the relative activity (average percentage of HLA-negative cells at day 21) versus specificity (median percentage of off-target CpG methylation at the VEGFA locus quantified at day 5) for LTRP proteins #1-5 harboring either the ZNF10- or ZIM-KRAB domain, and the LTRP proteins were benchmarked against catalytically-active CasX 491 and dCas9-ZNF10-DNMT3A/L, as described in Example 13.

FIG. 38 is a scatterplot mapping the activity-specificity profiles for LTRP molecules #1-5, containing either ZNF10- or ZIM3-KRAB domain, benchmarked against CasX 491 and dCas9-ZNF10-DNMT3A/L, where activity was measured as the average percentage of HLA-negative cells at day 21, and specificity was represented by the median percentage of off-target CpG methylation at the VEGFA locus detected at day 5. The data show that of the five LTRP molecules assessed, use of LTRP #5 resulted in the highest level of repressive activity, while use of LTRP #4 resulted in the strongest level of specificity.

The experiments demonstrate that the rationally-engineered LTRP molecules were able to transcriptionally and heritably repress the endogenous B2M locus, resulting in sustained depletion of the target protein. The findings also show that the choice of KRAB domain and position and relative configuration of the DNMT3A/L domains could affect the overall potency and specificity of the LTRP molecule in durably silencing the target locus.

Example 14: Demonstration that Inclusion of the ADD Domain from DNMT3A Enhances Activity and Specificity of LTRP Molecules In addition to its C-terminal methyltransferase domain, DNMT3A contains two N-terminal domains that regulate its function and recruitment to chromatin: the ADD domain and the PWWP domain. The PWWP domain reportedly interacts with methylated histone tails, including H3K36mc3. The ADD domain is known to have two key functions: 1) it allosterically regulates the catalytic activity of DNMT3A by serving as a methyltransferase auto-inhibitory domain, and 2) it recognizes unmethylated H3K4 (H3K4mc0). The interaction of the ADD domain with the H3K4me0 mark unveils the catalytic site of DNMT3A, thereby recruiting an active DNMT3A to chromatin to implement de novo methylation at these sites.

Given these functions of the ADD domain, experiments were performed to assess whether the incorporation of the ADD domain into the LTRP #5 construct, described previously in Example 13, would result in improved long-term repression of the target locus and reduced off-target methylation. The effect of incorporating the PWWP domain along with the ADD domain on LTRP activity and specificity was also assessed.

Materials and Methods

Generation of LTRP Constructs and Plasmid Cloning:

Plasmid constructs encoding for variants of the LTRP #5 construct with the ZIM3-KRAB domain (LTRP #5.A; see FIG. 1 for LTRP #5 configuration) were built using standard molecular cloning techniques. The resulting constructs comprised of sequences encoding for one of the following four alternative variations of LTRP5-ZIM3, where the additional DNMT3A domains were incorporated: 1) LTRP5-ZIM3+ADD; 2) LTRP5-ZIM3+ADD+PWWP; 3) LTRP5-ZIM3+ADD without the DNMT3A catalytic domain; and 4) LTRP5-ZIM3+ADD+PWWP without the DNMT3A catalytic domain. The sequences of key elements within the LTRP5-ZIM3 molecule and its variants are listed in Table 49, with the full-length protein sequence for each LTRP5-ZIM3 and its variants listed in Table 50. FIG. 45 is a schematic that illustrates the various LTRP #5 architectures assayed in this example. Sequences encoding the LTRP molecules also contained a 2x FLAG tag. Plasmids also harbored constructs encoding for the gRNA scaffold variant 174 having either a spacer targeting the endogenous B2M locus or a non-targeting control (spacer sequences listed in Table 51).

TABLE 49

Sequences of LTRP components (e.g., additional domains fused to dCasX) to generate LTRP5 variant plasmids illustrated in FIG. 45

| Component | Amino acid sequence SEQ ID NO |
|---|---|
| ZIM3 KRAB domain | 3240 |
| DNMT3A catalytic domain (CD) | 126 |
| DNMT3L interaction domain | 127 |
| dCasX491 | 4 |
| Linker 1 | 123 |
| Linker 2 | 122 |
| Linker 3A' | 124 |
| Linker 3B | 120 |
| Linker 4 | 121 |
| NLS A | 30 |
| NLS B | |
| DNMT3A ADD domain | 125 |
| DNMT3A PWWP domain | 3252 |
| Endogenous sequence between DNMT3A PWWP and ADD domains (endo) | 3253 |

TABLE 50

Protein sequences of LTRP5 variants assayed in this example

| LTRP ID | Amino acid sequence SEQ ID NO |
|---|---|
| LTRP5-ZIM3 | 3131 |
| LTRP5-ZIM3 + ADD | 3132 |
| LTRP5-ZIM3 + ADD + PWWP | 3254 |
| LTRP5-ZIM3 + ADD − CD | 3255 |
| LTRP5-ZIM3 + ADD + PWWP − CD | 3256 |

TABLE 51

Sequences of spacers used in constructs

| Spacer ID | Target gene | Sequence | SEQ ID NO |
|---|---|---|---|
| 0.0 | Non-target | CGAGACGUAAUUACGUCUCG | 3232 |
| 7.37 | B2M | GGCCGAGAUGUCUCGCUCCG | 3137 |
| 7.160 | B2M | UAAACAUCACGAGACUCUAA | 3113 |
| 7.165 | B2M | UCCCUAUGUCCUUGCUGUUU | 3114 |

Transfection of HEK293T Cells:

Seeded HEK293T cells were transiently transfected with 100 ng of LTRP5 variant plasmids, each containing an LTRP:gRNA construct encoding for LTRP5-ZIM3 or one of its alternative variations (FIG. 45; Table 50 for sequences), with the gRNA having either non-targeting spacer 0.0 or a B2M-targeting spacer (Table 51 for spacer sequences). Spacers 7.160 and 7.165 have been shown to be repress the B2M locus when used with LTRPs, but not when used with dXRs made up of a dCasX fused to the ZIM3 KRAB domain (data not shown). Each construct was tested in triplicate. 24 hours post-transfection, cells were selected with 1 μg/mL puromycin for three days. Cells were harvested for repression analysis at day 5, day 12, day 21, and day 51 post-transfection. Briefly, repression analysis was conducted by analyzing B2M protein expression via HLA immunostaining followed by flow cytometry, as described in Example 13. In addition, HEK293T cells transiently transfected with LTRP5 variant plasmids and a B2M-targeting gRNA or non-targeting gRNA were harvested at seven days post-transfection for gDNA extraction for bisulfite sequencing to assess off-target methylation at the VEGFA locus, which was performed as described in Example 13.

Results

The effects of incorporating the ADD domain with or without the PWWP domain into the LTRP5 molecule on increasing long-term repression of the target B2M locus and reducing off-target methylation were assessed. Variations of the LTRP5-ZIM3 molecule were evaluated with either a B2M-targeting gRNA (with spacer 7.37 and LTRP-specific spacers 7.160 and 7.165) or a non-targeting gRNA, and the results are depicted in the plots in FIGS. 39-42. FIG. 39 shows that use of spacer 7.37 resulted in saturating levels of repression activity when paired with LTRP5-ZIM3, LTRP5-ZIM3+ADD, and LTRP5-ZIM3+ADD+PWWP, rendering it more challenging to assess activity differences among the LTRP5 variants. However, the differences in repression activity among the LTRP5 variants were more pronounced when using spacers 7.160 and 7.165 (FIGS. 40 and 41). The data demonstrate that incorporation of the ADD domain resulted in a significant increase in long-term repression when paired with the two LTRP-specific spacers compared to the repression levels achieved with the other LTRP5-ZIM3 molecules. Meanwhile, incorporation of both ADD and PWWP domains did not result in improved repression of the B2M locus, especially compared to the baseline LTRP5-ZIM3 molecule. As anticipated, the two LTRP5 variants without the DNMT3A catalytic domain exhibited poor long-term repression. Furthermore, the results depicted in FIG. 42 indicate that addition of the ADD domain appeared to result in increased specificity, given the lower percentage of HLA-negative cells observed, relative to the baseline LTRP5-ZIM3 molecule.

Off-target CpG methylation at the VEGFA locus potentially mediated by the LTRP5 variants was assessed using bisulfite sequencing. FIG. 43 depicts the results from bisulfite sequencing, specifically showing the percentage of CpG methylation around the VEGFA locus. The results demonstrate that for all the B2M-targeting gRNAs, as well as the non-targeting gRNA, incorporation of the ADD domain into the LTRP5-ZIM3 molecule dramatically reduced the level of off-target methylation at the VEGFA locus (FIG. 43). FIG. 44 is a scatterplot mapping the activity-specificity profiles for the LTRP5-ZIM3 variants investigated in this example, where activity was measured as the average percentage of HLA-negative cells at day 21 when paired with spacer 7.160, and specificity was represented by the percentage of off-target CpG methylation at the VEGFA locus quantified at day 7 when paired with spacer 7.160. The scatterplot clearly shows that addition of the ADD domain significantly increased the activity of the LTRP5 molecule relative to the baseline ELX5 molecule without the ADD domain (FIG. 44).

The experiments demonstrate that inclusion of the DNMT3A ADD domain, but not inclusion of both the ADD and PWWP domains, improved repression activity and specificity of LTRP molecules. This enhancement of activity and specificity was observed with multiple gRNAs, demonstrating the significance of the incorporation of the ADD domain into LTRPs.

Example 15: Demonstration that Inclusion of the ADD Domain from DNMT3A into LTRPs Enhances On-Target Activity and Decreases Off-Target Methylation Experiments were performed to assess the effects of incorporating the ADD domain into LTRP molecules having configurations #1, #4, and #5, described previously in Example 13, on long-term repression of the target locus and off-target methylation.

Materials and Methods

Generation of LTRP Constructs and Plasmid Cloning:

Plasmid constructs encoding for LTRP molecules having configurations #1, #4, and #5 with the ZNF10-KRAB or ZIM3-KRAB domain and the DNMT3A ADD domain were built using standard molecular cloning techniques. Sequences of the resulting LTRP molecules are listed in Table 52, which also shows the abbreviated construct names for a particular LTRP molecule (e.g., LTRP #1.A, #1.B). FIG. 46 is a schematic that illustrates the general architectures of LTRP molecules with the ADD domain incorporated for LTRP configuration #1, #4, and #5. Sequences encoding the LTRP molecules also contained a 2x FLAG tag. Plasmids also harbored sequences encoding gRNA scaffold 174 having either a spacer targeting the endogenous B2M locus or a non-targeting control (spacer sequences listed in Table 51).

TABLE 52

Protein sequences of the various LTRP #1, #4, and #5 variants assayed in this example

| LTRP # | Domains | Amino acid sequence SEQ ID NO |
|---|---|---|
| LTRP #1 | ZNF10-KRAB, DNMT3A ADD, DNMT3A CD, DNMT3L Interaction (LTRP #1.D) | 3257 |
| | ZIM3-KRAB, DNMT3A ADD, DNMT3A CD, DNMT3L Interaction (LTRP #1.C) | 3258 |
| | ZNF10-KRAB, DNMT3A CD, DNMT3L Interaction (LTRP #1.B) | 3259 |
| | ZIM3-KRAB, DNMT3A CD, DNMT3L Interaction (LTRP #1.A) | 3066 |
| LTRP #4 | ZNF10-KRAB, DNMT3A ADD, DNMT3A CD, DNMT3L Interaction (LTRP #4.D) | 3260 |
| | ZIM3-KRAB, DNMT3A ADD, DNMT3A CD, DNMT3L Interaction (LTRP #4.C) | 3261 |
| | ZNF10-KRAB, DNMT3A CD, DNMT3L Interaction (LTRP #4.B) | 3262 |

TABLE 52-continued

| Protein sequences of the various LTRP #1, #4, and #5 variants assayed in this example | | |
|---|---|---|
| LTRP # | Domains | Amino acid sequence SEQ ID NO |
| | ZIM3-KRAB, DNMT3A CD, DNMT3L Interaction (LTRP #4.A) | 3263 |
| LTRP #5 | ZNF10-KRAB, DNMT3A ADD, DNMT3A CD, DNMT3L Interaction (LTRP #5.D) | 3264 |
| | ZIM3-KRAB, DNMT3A ADD, DNMT3A CD, DNMT3L Interaction (LTRP #5.C) | 3132 |
| | ZNF10-KRAB, DNMT3A CD, DNMT3L Interaction (LTRP #5.B) | 3265 |
| | ZIM3-KRAB, DNMT3A CD, DNMT3L Interaction (LTRP #5.A) | 3131 |

Transfection of HEK293T Cells:

Seeded HEK293T cells were transiently transfected with 100 ng of LTRP variant plasmids, each containing an LTRP:gRNA construct encoding for an LTRP molecule (Table 52;

FIG. 46), with the gRNA having either non-targeting spacer 0.0 or a B2M-targeting spacer (Table 51). Each construct was tested in triplicate. 24 hours post-transfection, cells were selected with 1 μg/mL puromycin for 3 days. Cells were harvested for repression analysis at day 8, day 13, day 20, and day 27 post-transfection. Briefly, repression analysis was conducted by analyzing B2M protein expression via HLA immunostaining followed by flow cytometry, as described in Example 13. In addition, cells were also harvested on day 5 post-transfection for gDNA extraction for bisulfite sequencing to assess off-target methylation at the non-targeted VEGFA locus, which was performed using similar methods as described in Example 13.

Results

The effects of incorporating the ADD domain into the LTRP molecules having configurations #1, #4, or #5 (see FIG. 2), with either a ZNF10 or ZIM-KRAB, on long-term repression of the B2M locus and off-target methylation were evaluated. LTRP molecules were tested with either a B2M-targeting gRNA or a non-targeting gRNA, and the results are depicted in the plots in FIGS. 47A-50B. The data demonstrate that incorporation of the ADD domain into the LTRP molecules clearly resulted in a substantial increase in B2M repression across all the time points for all LTRP configurations containing the ZIM3-KRAB when using spacer 7.160 (FIG. 47A), and similar findings were observed when using spacers 7.165 and 7.37 (data not shown). FIG. 47B shows the resulting B2M repression upon use of LTRP #5 containing either the ZNF10 or ZIM3-KRAB when paired with a gRNA with spacer 7.160; the data demonstrate that including the ADD domain increased durable B2M repression overall, with LTRP5-ZIM3+ADD having a higher activity compared with that of LTRP5-ZNF10+ADD. Similar time course findings were observed for LTRP #1 and LTRP #4 and the other two spacers (data not shown). FIG. 47C shows the resulting B2M repression upon use of LTRP #5 containing the ZIM3-KRAB when paired with any of the three B2M-targeting gRNAs, and the data demonstrate that inclusion of the ADD domain resulted in higher B2M repression overall. Similar time course findings were also observed for LTRP #1 and LTRP #4 (data not shown).

FIGS. 48A-48C shows the resulting B2M repression at the day 27 time point for all the LTRP configurations and gRNAs tested. The results show that the increase in B2M repression was more prominent with use of the sub-optimal spacers 7.160 and 7.165 compared to use of spacer 7.37. Furthermore, use of LTRP #1 and LTRP #5, which contained the DNMT3A and DNMT3L domains on the N-terminus of the molecule, resulted in the highest increase in B2M repression upon addition of the DNMT3A ADD domain (FIGS. 48A-48C). Use of LTRP #4, which harbored the DNMT3A/3L domains 3' to the KRAB domain and 5' to the dCasX, resulted in lower activity gains, which may be attributable to a decreased ability of the ADD domain to interact with chromatin properly.

The specificity of LTRP molecules was determined by profiling the level of CpG methylation at the VEGFA gene, an off-target locus, using bisulfite sequencing, and the data are illustrated in FIGS. 49A-52B. The data demonstrate that inclusion of the DNMT3A ADD domain resulted in a substantial decrease in off-target methylation of the VEGFA locus across all conditions tested (FIGS. 49A-49C). Notably, the increased specificity mediated by the inclusion of the ADD domain was most prominent with the LTRP #1 and LTRP #5 configurations, both of which harbored the DNMT3A/3L domains on the N-terminal end of the molecule. Interestingly, LTRP molecules containing the ZIM3-KRAB domain led to stronger off-target methylation of the VEGFA locus. Furthermore, use of LTRP #4 and #5 configurations, even in the absence of an ADD domain, resulted in higher specificity compared to use of the LTRP #1 configuration. Compared to LTRP1-ZIM3 and LTRP4-ZIM3 configurations, inclusion of the ADD domain into LTRP5-ZIM3 resulted in the lowest off-target methylation.

FIGS. 50A-52B are a series of scatterplots mapping the activity-specificity profiles for the various LTRP molecules, where activity was measured as the average percentage of HLA-negative cells at day 27, and specificity was determined by the percentage of off-target CpG methylation at the VEGFA locus at day 5. The data demonstrate that across all three B2M-targeting spacers tested, inclusion of the ADD domain resulted in increased on-target B2M repression and decreased off-target methylation at the VEGFA locus. LTRP molecules having #1 and #5 configurations exhibited the greatest increases in activity and specificity at each spacer tested.

The results of the experiments discussed in this example support the findings in Example 14, in that the data demonstrate that inclusion of the DNMT3A ADD domain enhances both the strength of repression at early timepoints and the heritability of silencing across cell divisions, as well as decreases the off-target methylation incurred by the DNMT3A catalytic domain in the LTRP molecules. The data also confirm that different LTRP configurations have intrinsic differences in specificity, which can be exacerbated by use of a more potent KRAB domain. This decrease in specificity can be mitigated by inclusion of the DNMT3A ADD domain, which also can lead to greater on-target repression overall. The gains in repression activity are believed to be mediated by the function of the DNMT3A ADD domain to recognize H3K4me0 and subsequent recruitment to chromatin. The gains in specificity are believed to be mediated via the function of the DNMT3A ADD domain to induce allosteric inhibition of the catalytic domain of DNMT3A in the absence of binding to H3K4me0. The results also highlight that positioning of the ADD domain in the different configurations tested is important to achieve the strongest gains in both specificity and activity of LTRP molecules.

Example 16: Demonstration of dXR Effectiveness on HBEGF for High-Throughput Screening Experiments were performed to determine the feasibility of using dXR constructs for high-throughput screening of molecules in mammalian cells.

Materials and Methods

HEK293T cells were seeded in a 6-well plate at 300,000 cells/well and lipofected with 1 μg of plasmid encoding either a CasX molecule (491), a catalytically-dead CasX 491 with the ZNF10-KRAB repressor domain (dXR) and a guide scaffold 174 (SEQ ID NO: 1744) with a spacer targeting the HBEGF gene or a non-targeting spacer. Five combinations of CasX-based molecules and gRNAs with the indicated spacers (Table 53) were transfected into five separate wells. HBEGF is the receptor that mediates entry of diphtheria toxin that, when added to the cells, inhibits translation and leads to cell death. Targeting of the HBEGF gene with a CasX or dXR molecule and targeting gRNA should prevent toxin entry and allow survival of the cells, whereas cells treated with CasX and dXR molecules and a non-targeting gRNA should not survive. One day post-transfection, cells in each transfected well were split into 12 different wells in a 96-well plate and selected with puromycin. Over three days, cells were treated with six different concentrations of diphtheria toxin (0, 0.2, 2, 20, 200, and 2000 ng/mL), and biological duplicates were performed. After another two days, cells were split into fresh media, and total cell counts were measured on an ImageXpress® Pico Automated Cell Imaging System.

TABLE 53

Sequences of spacers tested

| Spacer ID | RNA sequence | SEQ ID NO | Molecule |
|---|---|---|---|
| 34.19 | ACUGGGAGGCUCAGCCCAUG | 3266 | CasX |
| 34.21 | UGUUCUGUCUUGAACUAGCU | 3267 | CasX |
| 34.28 | UGAGUGUCUUGUCUUGCUCA | 3268 | dXR |
| 0.0 | CGAGACGUAAUUACGUCUCG | 3232 | CasX & dXR |

Results

The results of the diphtheria toxin assay are illustrated in the plot in FIG. 53. dXR-mediated repression of the HBEGF gene resulted in survival of cells, but only at low doses of toxin (0.2-20 ng/mL). However, those same doses led to complete cell death in the control cells treated with non-targeting constructs. High doses (>20 ng/ml) of toxin led to cell death in both the dXR and control samples, suggesting that the basal level of transcription permitted by dXR allows sufficient toxin to enter and trigger cell death. The results show that CasX-edited cells remained protected as editing of the locus leads to complete loss of functional protein. The non-targeting controls died at all doses, demonstrating the efficacy of the toxin when HBEGF is not repressed or edited.

The results show that dXR protects at low doses of toxin, demonstrating that this construct can be screened in a range of 0.2-20 ng/mL diphtheria toxin, with highest fold-enrichment between dXR and control observed at 0.2 ng/mL. Note that while CasX protects at all doses, repression by dXR still induced low basal expression of the target that led to toxicity of the cells at high doses of the toxin.

Example 17: Development of a selection scheme to identify improved repressor domains for inclusion in repressor fusion proteins To develop better LTRP fusion protein constructs, a library of transcriptional effector domains from many non-human species was tested in a selection assay. As KRAB domains are one of the largest and most rapidly-evolved domains in vertebrates, repressor domains from species not previously evaluated were anticipated to provide improved strength and permanence of repression.

Materials and Methods

Identification of Candidate Repressor Domains:

Homologs of KRAB domains were identified by downloading all sequences annotated with Prosite accession ps50805 (the accession number for KRAB domains). All domains were extended by 100 amino acids (with the annotation centered in the middle) to include potential unannotated functional sequences. In addition, HMMER, a tool to identify domains, was run on a set of high-quality primate annotations from recently completed alignments of long-read primate genome assemblies described (Warren, W C, et al. Sequence diversity analyses of an improved rhesus macaque genome enhance its biomedical utility. Science 370, Issue 6523, eabc6617 in (2020); Fiddes, I T, et al. Comparative Annotation Toolkit (CAT)-simultaneous clade and personal genome annotation. Genome Res. 28(7):1029 (2018); Mao, Y, et al. A high-quality bonobo genome refines the analysis of hominid evolution. Nature 594:77 (2021)), to identify domains in these assemblies, most of which were not present in UniProt. The search resulted in 32, 120 unique sequences from 159 different organisms for testing for their potency in transcriptional repression. Additionally, 580 random amino acid sequence 80 residues in length were included in the library as negative controls, and 304 human KRAB domains were included based on work by Tycko, J. et al. (*Cell.* 2020 Dec. 23; 183(7):2020-2035).

Screening Methods:

The domains described above were synthesized as DNA oligos, amplified, and cloned into a dCasX491 C-terminal GS linker lentiviral construct along with guide scaffold 174 (SEQ ID NO: 1744) with Spacer 34.28, to repress HBEGF and confer survival in a diphtheria toxin selection as described in Example 16, above. For each domain, the C-terminal GS linker was synonymously substituted to produce unique DNA barcodes that could be differentiated by NGS allowing internal technical replicates to be assessed in each pooled experiment. These plasmids were used to generate the lentiviral constructs of the library.

HEK293T cells were transduced, treated with 1 μg/mL puromycin to remove untransduced cells, and selection was carried out at 2 ng/ml diphtheria toxin for 48 hours. gDNA was extracted, amplified, and sequenced as described above. gDNA samples were also extracted, amplified, and sequenced from the cells before selection with diphtheria toxin, as a control. Two independent replicates were performed for the diphtheria toxin selection.

Assessment of B2M Repression:

Representative domains were cloned into a dCasX491 C-terminal GS linker lentiviral construct along with guide scaffold 316 (SEQ ID NO: 1746) with spacer 7.15 (GGAAUGCCCGCCAGCGCGAC; SEQ ID NO: 3110), targeting the B2M locus. Separately, representative domains were cloned into a dCasX491 C-terminal GS linker lentiviral construct along with guide scaffold 174 (SEQ ID NO: 1744) with spacer 7.37 (GGCCGAGAUGUCUCGCUCCG; SEQ ID NO: 3137), targeting the B2M locus. The lentiviral plasmid constructs encoding dXRs with various domains were generated using standard molecular cloning techniques. These constructs included sequences encoding dCasX491, and a KRAB domain from ZNF10, ZIM3, or one of the domains tested in the library. Cloned and sequence-validated constructs were midi-prepped and subjected to quality assessment prior to transfection in HEK293T cells.

HEK293T cells were seeded at a density of 30,000 cells in each well of a 96-well plate. The next day, each well was transiently transfected using Lipofectamine™ with 100 ng of dXR plasmids, each containing a dXR construct with a different domain and a gRNA having a targeting spacer to the B2M locus. Experimental controls included dXR constructs with KRAB domains from ZNF10 or ZIM3, domains that were in the library but not among the top 95 or 1597 most effective repressors, or dCas9-ZNF10, each with a corresponding B2M-targeting gRNA. Each construct was tested in triplicate. 24 hours post-transfection, cells were selected with 1 μg/mL puromycin for two days. Seven or ten days after transfection, cells were harvested for editing repression analysis by analyzing B2M protein expression via HLA immunostaining followed by flow cytometry. B2M expression was determined by using an antibody that would detect the B2M-dependent HLA protein expressed on the cell surface. HLA+ cells were measured using the Attune™ NxT flow cytometer.

Data Analysis

To understand the diversity of protein sequences in the tested library, an evolutionary scale modeling (ESM) transformer (ESM-1b) was applied to the initial library of 32,120 domain amino acid sequences to generate a high dimensional representation of the sequences (Rives, A. et al. *Proc Natl Acad Sci USA.* 2021 Apr. 13; 118(15)). Next, Uniform Manifold Approximation and Projection (UMAP) was applied to reduce the data set to a two-dimensional representation of the sequence diversity (McInnes, L., Healy, J., *ArXiv e-prints* 1802.03426, 2018). Using this technique, 75 clusters of domain sequences were identified.

Protein sequence motifs were generated using the STREME algorithm (Bailey, T., *Bioinformatics.* 2021 Mar. 24; 37(18):2834-2840) to identify motifs enriched in strong repressors.

Results

Selections were performed to identify the domains out of a library of 32,120 unique sequences that were the most potent transcriptional repressors. The fold change in the abundance of each domain in the library before and after selection was calculated for each barcode-domain pair such that together the two independent replicates of the experiment represent 12 measurements of each domain's fitness.

FIG. 54 shows the range of log 2 (fold change) values for the entire library, the randomized sequences that served as negative controls, a positive control set of KRAB domains that were shown to have a log 2 (fold change) greater than 1 on day 5 of the HT-recruit experiment performed by Tycko et al. (*Cell.* 2020 Dec. 23; 183(7):2020-2035). As shown in FIG. 54, the diphtheria toxin selection successfully enriched for domains that were more potent transcriptional repressors. The negative control sequences were de-enriched from the library following selection.

To identify the domains that were reproducibly enriched in the post-selection library, a p-value threshold of less than 0.01 and a log 2 (fold change) threshold of greater than 2 was set. 1597 domains met these criteria. P-values were calculated via the MAGeCK algorithm which uses a permutation test and false discovery rate adjustment for multiple testing (Wei, L. et al. *Genome Biol.* 2014; 15(12):554). The log 2 (fold change) values of these top 1597 repressor domains are shown in FIG. 54, and the amino acid sequences, p-values, and log 2 (fold change) values are provided in Table 54, below. In contrast, ZIM3 had a log 2 (fold change) of 1.7787, standard ZNF10 had a log 2 (fold change) of 1.3637, and an alternate ZNF10 corresponding to the ZNF10 KRAB domain used in Tycko, J. et al. (*Cell.* 2020 Dec. 23; 183(7):2020-2035) had a log 2 (fold change) of 1.6182. Therefore, the 1597 top repressor domains were substantially superior transcriptional repressors to ZNF10 and ZIM3. Many of these top repressor domains contained amino acids with residues that are predicted to stabilize interactions with the Trim28 protein when compared to ZIM3 and ZNF10 (Stoll, G. A. et al., *bioRxiv* 2022.03.17.484746).

To further narrow down the list of repressor domains while maintaining a breadth of amino acid sequence diversity, a set of 95 repressor domains was chosen from within the 1597 by selecting the most effective repressor from each cluster, as well as the top 25 best repressors of the 1597, as shown in Table 54.

TABLE 54

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| Top 95 most effective repressor domains | | | | |
| DOMAIN_7694 | *Columba livia* | 130 | 3.7111 | 1.13E−04 |
| DOMAIN_10123 | *Rattus norvegicus* | 131 | 3.6356 | 8.11E−06 |
| DOMAIN_15507 | *Cebus imitator* | 132 | 3.8531 | 1.53E−07 |
| DOMAIN_17905 | Chimp | 133 | 2.5038 | 5.60E−04 |
| DOMAIN_20505 | *Chlorocebus sabaeus* | 134 | 3.4989 | 2.91E−06 |
| DOMAIN_26749 | *Ophiophagus hannah* | 135 | 5.4323 | 1.53E−07 |
| DOMAIN_27604 | *Ailuropoda melanoleuca* | 136 | 2.8198 | 6.05E−05 |
| DOMAIN_29304 | *Peromyscus maniculatus bairdii* | 137 | 4.0496 | 1.53E−07 |
| DOMAIN_30173 | *Phyllostomus discolor* | 138 | 2.2538 | 5.41E−04 |
| DOMAIN_737 | *Bonobo* | 139 | 4.544 | 1.53E−07 |
| DOMAIN_10331 | *Colobus angolensis palliatus* | 140 | 3.6796 | 1.53E−07 |
| DOMAIN_10948 | *Colobus angolensis palliatus* | 141 | 3.2959 | 2.30E−06 |
| DOMAIN_11029 | *Mandrillus leucophaeus* | 142 | 3.5748 | 1.53E−07 |
| DOMAIN_17358 | *Bos indicus × Bos taurus* | 143 | 4.9878 | 1.53E−07 |
| DOMAIN_17759 | *Felis catus* | 144 | 3.3159 | 1.38E−06 |
| DOMAIN_18258 | *Physeter macrocephalus* | 145 | 3.75 | 3.42E−04 |
| DOMAIN_19804 | *Callorhinus ursinus* | 146 | 3.8217 | 1.53E−07 |
| DOMAIN_221 | Bonobo | 147 | 3.5533 | 3.06E−06 |
| DOMAIN_881 | Bonobo | 148 | 4.3546 | 4.59E−07 |
| DOMAIN_2380 | Orangutan | 149 | 3.2024 | 1.74E−04 |
| DOMAIN_2942 | Gibbon | 150 | 3.3658 | 1.38E−06 |
| DOMAIN_4687 | Marmoset | 151 | 5.2288 | 3.22E−06 |
| DOMAIN_4806 | Marmoset | 152 | 3.3896 | 1.58E−04 |
| DOMAIN_4968 | Marmoset | 153 | 3.0315 | 0.0022262 |
| DOMAIN_5066 | Marmoset | 154 | 2.9062 | 0.0067409 |
| DOMAIN_5290 | Owl Monkey | 155 | 3.0993 | 5.16E−05 |
| DOMAIN_5463 | Owl Monkey | 156 | 3.2102 | 0.0022788 |
| DOMAIN_6248 | *Saimiri boliviensis boliviensis* | 157 | 2.4415 | 0.0056883 |
| DOMAIN_6445 | *Alligator sinensis* | 158 | 3.1151 | 4.51E−04 |
| DOMAIN_6802 | *Pantherophis guttatus* | 159 | 3.0403 | 5.18E−04 |
| DOMAIN_6807 | *Xenopus laevis* | 160 | 3.1615 | 5.16E−05 |
| DOMAIN_7255 | *Microcaecilia unicolor* | 161 | 4.5265 | 1.38E−06 |
| DOMAIN_8503 | *Mus caroli* | 162 | 2.8193 | 0.003503 |
| DOMAIN_8790 | *Marmota monax* | 163 | 2.7436 | 2.06E−04 |
| DOMAIN_8853 | *Mesocricetus auratus* | 164 | 4.6199 | 1.53E−07 |
| DOMAIN_9114 | *Peromyscus maniculatus bairdii* | 165 | 2.2058 | 0.0048423 |
| DOMAIN_9331 | *Peromyscus maniculatus bairdii* | 166 | 4.1063 | 4.59E−07 |
| DOMAIN_9538 | *Mus musculus* | 167 | 3.5443 | 1.20E−04 |
| DOMAIN_9960 | *Octodon degus* | 168 | 3.4751 | 1.07E−06 |
| DOMAIN_10277 | *Dipodomys ordii* | 169 | 2.8257 | 4.16E−04 |
| DOMAIN_10577 | *Colobus angolensis palliatus* | 170 | 4.1248 | 1.53E−07 |
| DOMAIN_11348 | *Chlorocebus sabaeus* | 171 | 3.3651 | 2.95E−05 |
| DOMAIN_11386 | *Capra hircus* | 172 | 3.7637 | 4.75E−06 |
| DOMAIN_11486 | *Bos mutus* | 173 | 4.8326 | 1.53E−07 |
| DOMAIN_11683 | *Nomascus leucogenys* | 174 | 2.9249 | 0.0015672 |
| DOMAIN_12292 | *Sus scrofa* | 175 | 4.3194 | 1.53E−07 |
| DOMAIN_12452 | *Neophocaena asiaeorientalis asiaeorientalis* | 176 | 3.8774 | 5.05E−06 |
| DOMAIN_12631 | *Macaca fascicularis* | 177 | 3.6926 | 1.53E−07 |
| DOMAIN_13331 | *Macaca fascicularis* | 178 | 3.5154 | 2.15E−04 |
| DOMAIN_13468 | *Phascolarctos cinereus* | 179 | 4.1548 | 1.38E−06 |
| DOMAIN_13539 | Gorilla | 180 | 3.4924 | 1.79E−05 |
| DOMAIN_14659 | *Acinonyx jubatus* | 181 | 4.0495 | 1.06E−05 |
| DOMAIN_14755 | *Cebus imitator* | 182 | 3.1667 | 1.88E−04 |
| DOMAIN_15126 | *Callithrix jacchus* | 183 | 2.9781 | 4.08E−04 |
| DOMAIN_16444 | *Acinonyx jubatus* | 184 | 3.2246 | 2.30E−06 |
| DOMAIN_16688 | *Lipotes vexillifer* | 185 | 3.5601 | 4.26E−05 |
| DOMAIN_16806 | *Sapajus apella* | 186 | 3.9386 | 1.53E−07 |
| DOMAIN_17317 | *Otolemur garnettii* | 187 | 3.4551 | 1.81E−04 |
| DOMAIN_17432 | *Otolemur garnettii* | 188 | 3.11 | 1.36E−05 |
| DOMAIN_18137 | *Monodelphis domestica* | 189 | 3.292 | 3.51E−05 |
| DOMAIN_18216 | *Physeter macrocephalus* | 190 | 3.0602 | 9.40E−04 |
| DOMAIN_18563 | Owl Monkey | 191 | 3.0406 | 0.0034849 |
| DOMAIN_19229 | *Enhydra lutris kenyoni* | 192 | 4.0294 | 5.01E−05 |
| DOMAIN_19460 | *Monodelphis domestica* | 193 | 3.995 | 1.97E−05 |
| DOMAIN_19476 | Owl Monkey | 194 | 4.1343 | 1.53E−07 |
| DOMAIN_19821 | *Rhinopithecus roxellana* | 195 | 3.583 | 1.53E−07 |
| DOMAIN_19892 | *Ursus maritimus* | 196 | 3.1396 | 5.21E−04 |
| DOMAIN_19896 | *Ovis aries* | 197 | 2.2228 | 1.58E−04 |
| DOMAIN_19949 | *Callorhinus ursinus* | 198 | 3.2903 | 2.62E−04 |
| DOMAIN_21247 | *Neovison vison* | 199 | 2.741 | 0.0043129 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_21317 | *Pteropus vampyrus* | 200 | 4.0893 | 1.18E-05 |
| DOMAIN_21336 | *Equus caballus* | 201 | 2.738 | 0.005135 |
| DOMAIN_21603 | *Lipotes vexillifer* | 202 | 2.8535 | 4.35E-04 |
| DOMAIN_21755 | *Equus caballus* | 203 | 3.1889 | 0.0028238 |
| DOMAIN_22153 | *Zalophus californianus* | 204 | 3.6967 | 3.52E-06 |
| DOMAIN_22270 | Bonobo | 205 | 2.3813 | 0.0030391 |
| DOMAIN_23394 | *Vicugna pacos* | 206 | 4.0769 | 3.06E-07 |
| DOMAIN_23723 | *Carlito syrichta* | 207 | 3.5301 | 8.71E-05 |
| DOMAIN_24125 | *Saimiri boliviensis boliviensis* | 208 | 3.9692 | 1.53E-07 |
| DOMAIN_24458 | *Lynx pardinus* | 209 | 3.4012 | 9.66E-05 |
| DOMAIN_24663 | *Myotis brandtii* | 210 | 2.9806 | 1.49E-04 |
| DOMAIN_25289 | *Ursus maritimus* | 211 | 3.4113 | 7.70E-05 |
| DOMAIN_25379 | *Sapajus apella* | 212 | 3.5892 | 1.53E-07 |
| DOMAIN_25405 | *Desmodus rotundus* | 213 | 3.8846 | 3.20E-05 |
| DOMAIN_26070 | *Geotrypetes seraphini* | 214 | 3.7958 | 1.53E-07 |
| DOMAIN_26322 | *Geotrypetes seraphini* | 215 | 2.9265 | 7.13E-04 |
| DOMAIN_26732 | *Meleagris gallopavo* | 216 | 2.7548 | 0.0057183 |
| DOMAIN_27060 | *Gopherus agassizii* | 217 | 2.7943 | 0.0029172 |
| DOMAIN_27385 | *Octodon degus* | 218 | 4.1339 | 2.77E-05 |
| DOMAIN_27506 | *Bos mutus* | 219 | 3.8121 | 4.29E-06 |
| DOMAIN_27811 | *Callithrix jacchus* | 220 | 2.9728 | 8.34E-05 |
| DOMAIN_28640 | *Colinus virginianus* | 221 | 3.624 | 4.13E-06 |
| DOMAIN_28803 | *Monodelphis domestica* | 222 | 3.0697 | 2.07E-05 |
| DOMAIN_30661 | *Physeter macrocephalus* | 223 | 2.15 | 4.76E-05 |
| DOMAIN_31643 | *Micrurus lemniscatus lemniscatus* | 224 | 3.8782 | 3.57E-04 |
| Remaining repressor domains in the top 1597 most effective repressor domains | | | | |
| DOMAIN_10870 | *Vicugna pacos* | 225 | 2.5964 | 0.004315 |
| DOMAIN_10918 | *Odobenus rosmarus divergens* | 226 | 3.2079 | 9.21E-04 |
| DOMAIN_92 | Bonobo | 227 | 2.1475 | 0.0021413 |
| DOMAIN_98 | Bonobo | 228 | 2.7848 | 0.0055875 |
| DOMAIN_134 | Bonobo | 229 | 2.9322 | 0.004676 |
| DOMAIN_143 | Bonobo | 230 | 3.63 | 3.17E-05 |
| DOMAIN_145 | Bonobo | 231 | 3.1497 | 4.09E-05 |
| DOMAIN_214 | Bonobo | 232 | 2.1073 | 0.00941 |
| DOMAIN_225 | Bonobo | 233 | 2.259 | 0.0013991 |
| DOMAIN_226 | Bonobo | 234 | 3.0188 | 2.76E-04 |
| DOMAIN_235 | Bonobo | 235 | 2.9615 | 0.0016622 |
| DOMAIN_302 | Bonobo | 236 | 2.5092 | 0.0033327 |
| DOMAIN_313 | Bonobo | 237 | 2.4558 | 0.0049862 |
| DOMAIN_344 | Bonobo | 238 | 2.4948 | 0.0087725 |
| DOMAIN_362 | Bonobo | 239 | 3.6736 | 2.38E-04 |
| DOMAIN_382 | Bonobo | 240 | 3.1625 | 0.0019781 |
| DOMAIN_389 | Bonobo | 241 | 3.011 | 3.42E-04 |
| DOMAIN_407 | Bonobo | 242 | 3.8312 | 1.59E-04 |
| DOMAIN_418 | Bonobo | 243 | 3.2429 | 1.37E-04 |
| DOMAIN_419 | Bonobo | 244 | 3.5913 | 5.13E-05 |
| DOMAIN_421 | Bonobo | 245 | 3.2969 | 1.06E-05 |
| DOMAIN_451 | Bonobo | 246 | 3.0774 | 0.0018269 |
| DOMAIN_504 | Bonobo | 247 | 3.2187 | 4.17E-04 |
| DOMAIN_516 | Bonobo | 248 | 2.0448 | 0.0018554 |
| DOMAIN_621 | Bonobo | 249 | 2.1025 | 0.0034678 |
| DOMAIN_623 | Bonobo | 250 | 3.3299 | 6.50E-04 |
| DOMAIN_624 | Bonobo | 251 | 2.8281 | 0.0031625 |
| DOMAIN_629 | Bonobo | 252 | 3.6318 | 1.09E-05 |
| DOMAIN_668 | Bonobo | 253 | 2.9256 | 6.60E-04 |
| DOMAIN_718 | Bonobo | 254 | 3.9 | 8.73E-06 |
| DOMAIN_731 | Bonobo | 255 | 2.1318 | 0.0058273 |
| DOMAIN_749 | Bonobo | 256 | 3.1162 | 0.0060655 |
| DOMAIN_759 | Bonobo | 257 | 3.3019 | 0.0046077 |
| DOMAIN_761 | Bonobo | 258 | 3.181 | 9.64E-04 |
| DOMAIN_784 | Bonobo | 259 | 2.4886 | 0.0083818 |
| DOMAIN_801 | Bonobo | 260 | 2.4863 | 0.0040602 |
| DOMAIN_802 | Bonobo | 261 | 2.6563 | 5.66E-04 |
| DOMAIN_811 | Bonobo | 262 | 2.4706 | 0.0035997 |
| DOMAIN_812 | Bonobo | 263 | 2.8201 | 0.0013526 |
| DOMAIN_888 | Bonobo | 264 | 2.8951 | 0.0033756 |
| DOMAIN_893 | Bonobo | 265 | 2.7511 | 5.41E-04 |
| DOMAIN_938 | Bonobo | 266 | 2.2926 | 0.0040367 |
| DOMAIN_966 | Chimp | 267 | 3.3535 | 5.49E-04 |
| DOMAIN_972 | Chimp | 268 | 3.7627 | 5.59E-05 |
| DOMAIN_980 | Chimp | 269 | 2.9297 | 0.0011707 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_987 | Chimp | 270 | 2.6881 | 5.48E−04 |
| DOMAIN_999 | Chimp | 271 | 2.7361 | 0.0038248 |
| DOMAIN_1006 | Chimp | 272 | 3.2119 | 1.28E−04 |
| DOMAIN_1079 | Chimp | 273 | 3.7915 | 3.90E−05 |
| DOMAIN_1137 | Chimp | 274 | 3.1719 | 4.58E−04 |
| DOMAIN_1153 | Chimp | 275 | 3.7928 | 5.16E−04 |
| DOMAIN_1184 | Chimp | 276 | 3.2772 | 5.47E−04 |
| DOMAIN_1237 | Chimp | 277 | 2.1795 | 0.0059151 |
| DOMAIN_1242 | Chimp | 278 | 2.7144 | 0.0037672 |
| DOMAIN_1247 | Chimp | 279 | 2.9622 | 4.18E−04 |
| DOMAIN_1378 | Gorilla | 280 | 3.2279 | 0.0022191 |
| DOMAIN_1381 | Gorilla | 281 | 4.1424 | 3.35E−05 |
| DOMAIN_1382 | Gorilla | 282 | 3.0579 | 1.91E−04 |
| DOMAIN_1457 | Gorilla | 283 | 2.6896 | 0.0026956 |
| DOMAIN_1523 | Gorilla | 284 | 2.8607 | 0.0042127 |
| DOMAIN_1539 | Gorilla | 285 | 2.9337 | 0.0028055 |
| DOMAIN_1561 | Gorilla | 286 | 2.8783 | 0.0011557 |
| DOMAIN_1565 | Gorilla | 287 | 2.771 | 3.04E−04 |
| DOMAIN_1578 | Gorilla | 288 | 3.4875 | 5.97E−04 |
| DOMAIN_1621 | Gorilla | 289 | 3.3004 | 1.20E−04 |
| DOMAIN_1790 | Gorilla | 290 | 3.0669 | 0.0038707 |
| DOMAIN_1816 | Gorilla | 291 | 3.108 | 0.0011178 |
| DOMAIN_1818 | Gorilla | 292 | 3.2866 | 6.15E−04 |
| DOMAIN_1822 | Gorilla | 293 | 2.4697 | 1.04E−04 |
| DOMAIN_1870 | Gorilla | 294 | 2.215 | 0.0044522 |
| DOMAIN_1875 | Gorilla | 295 | 2.5576 | 0.0043383 |
| DOMAIN_1893 | Gorilla | 296 | 2.3898 | 0.0043422 |
| DOMAIN_1946 | Orangutan | 297 | 3.1449 | 9.41E−04 |
| DOMAIN_1952 | Orangutan | 298 | 3.0762 | 5.53E−04 |
| DOMAIN_1964 | Orangutan | 299 | 2.3009 | 0.0099771 |
| DOMAIN_1978 | Orangutan | 300 | 3.2215 | 0.0029968 |
| DOMAIN_2014 | Orangutan | 301 | 2.7323 | 3.95E−04 |
| DOMAIN_2034 | Orangutan | 302 | 3.7415 | 1.38E−06 |
| DOMAIN_2119 | Orangutan | 303 | 2.2117 | 0.0054271 |
| DOMAIN_2208 | Orangutan | 304 | 2.3044 | 0.009903 |
| DOMAIN_2223 | Orangutan | 305 | 2.6106 | 0.0087315 |
| DOMAIN_2229 | Orangutan | 306 | 2.9337 | 0.0032308 |
| DOMAIN_2245 | Orangutan | 307 | 3.2712 | 0.0012727 |
| DOMAIN_2255 | Orangutan | 308 | 3.1952 | 0.002815 |
| DOMAIN_2295 | Orangutan | 309 | 3.2816 | 6.61E−04 |
| DOMAIN_2299 | Orangutan | 310 | 2.5125 | 0.0042678 |
| DOMAIN_2376 | Orangutan | 311 | 2.1539 | 9.52E−04 |
| DOMAIN_2391 | Orangutan | 312 | 2.4608 | 0.0045936 |
| DOMAIN_2398 | Orangutan | 313 | 3.3125 | 3.44E−04 |
| DOMAIN_2470 | Orangutan | 314 | 2.3815 | 0.0031273 |
| DOMAIN_2499 | Orangutan | 315 | 3.114 | 0.0050479 |
| DOMAIN_2563 | Orangutan | 316 | 2.8105 | 0.003781 |
| DOMAIN_2576 | Orangutan | 317 | 3.1733 | 2.56E−04 |
| DOMAIN_2590 | Orangutan | 318 | 2.8348 | 0.0091663 |
| DOMAIN_2629 | Orangutan | 319 | 3.092 | 0.0015715 |
| DOMAIN_2652 | Orangutan | 320 | 4.3981 | 4.59E−07 |
| DOMAIN_2744 | Gibbon | 321 | 2.863 | 0.003897 |
| DOMAIN_2754 | Gibbon | 322 | 3.7601 | 1.17E−04 |
| DOMAIN_2786 | Gibbon | 323 | 2.5449 | 0.0037666 |
| DOMAIN_2806 | Gibbon | 324 | 3.1649 | 0.0083733 |
| DOMAIN_2808 | Gibbon | 325 | 2.6227 | 0.0079231 |
| DOMAIN_2813 | Gibbon | 326 | 2.9522 | 4.12E−04 |
| DOMAIN_2851 | Gibbon | 327 | 3.3945 | 3.80E−04 |
| DOMAIN_2867 | Gibbon | 328 | 3.0591 | 4.79E−04 |
| DOMAIN_2888 | Gibbon | 329 | 2.4267 | 0.0043214 |
| DOMAIN_2891 | Gibbon | 330 | 2.7489 | 0.0082897 |
| DOMAIN_2896 | Gibbon | 331 | 2.7253 | 0.0094587 |
| DOMAIN_2904 | Gibbon | 332 | 2.8035 | 0.0019408 |
| DOMAIN_2908 | Gibbon | 333 | 2.6452 | 0.0062379 |
| DOMAIN_2943 | Gibbon | 334 | 2.9574 | 9.75E−04 |
| DOMAIN_2962 | Gibbon | 335 | 2.1784 | 6.34E−04 |
| DOMAIN_2992 | Gibbon | 336 | 2.6341 | 0.0045667 |
| DOMAIN_2994 | Gibbon | 337 | 3.1921 | 0.0022412 |
| DOMAIN_2997 | Gibbon | 338 | 2.9911 | 0.0016588 |
| DOMAIN_3000 | Gibbon | 339 | 2.9522 | 5.36E−04 |
| DOMAIN_3062 | Gibbon | 340 | 2.6076 | 0.0035414 |
| DOMAIN_3087 | Gibbon | 341 | 2.7999 | 5.44E−04 |
| DOMAIN_3092 | Gibbon | 342 | 3.1954 | 2.80E−05 |

TABLE 54-continued

List of 1,597 repressor domain candidates identified from the high-throughput screen assessing dXR repression of the HBEGF gene and subsequent application of the following criteria: p-value <0.01 and $\log_2$(fold change) >2

| Domain ID | Species | SEQ ID NO | Log2 (fold change) | P-value |
|---|---|---|---|---|
| DOMAIN_3094 | Gibbon | 343 | 3.7195 | 2.83E−05 |
| DOMAIN_3096 | Gibbon | 344 | 3.3962 | 2.16E−04 |
| DOMAIN_3123 | Gibbon | 345 | 3.1293 | 1.88E−05 |
| DOMAIN_3137 | Gibbon | 346 | 2.8303 | 0.0038836 |
| DOMAIN_3300 | Gibbon | 347 | 3.0127 | 2.76E−04 |
| DOMAIN_3328 | Gibbon | 348 | 2.3718 | 0.0015893 |
| DOMAIN_3332 | Gibbon | 349 | 2.8786 | 0.0036582 |
| DOMAIN_3335 | Gibbon | 350 | 4.0001 | 4.75E−06 |
| DOMAIN_3336 | Gibbon | 351 | 3.5946 | 4.75E−06 |
| DOMAIN_3337 | Gibbon | 352 | 2.9398 | 0.0053162 |
| DOMAIN_3344 | Gibbon | 353 | 3.2218 | 4.60E−04 |
| DOMAIN_3373 | Gibbon | 354 | 3.0768 | 0.0030033 |
| DOMAIN_3434 | Gibbon | 355 | 2.4767 | 0.0035835 |
| DOMAIN_3463 | Gibbon | 356 | 3.5462 | 5.96E−04 |
| DOMAIN_3557 | Rhesus | 357 | 2.4416 | 0.0024889 |
| DOMAIN_3575 | Rhesus | 358 | 3.7842 | 1.53E−07 |
| DOMAIN_3585 | Rhesus | 359 | 2.4981 | 0.0036466 |
| DOMAIN_3586 | Rhesus | 360 | 2.365 | 0.0033728 |
| DOMAIN_3602 | Rhesus | 361 | 2.0444 | 0.0061662 |
| DOMAIN_3661 | Rhesus | 362 | 2.4083 | 0.0088114 |
| DOMAIN_3691 | Rhesus | 363 | 2.8393 | 0.0018244 |
| DOMAIN_3759 | Rhesus | 364 | 2.5324 | 0.004454 |
| DOMAIN_3760 | Rhesus | 365 | 2.7025 | 0.0017399 |
| DOMAIN_3781 | Rhesus | 366 | 2.9317 | 0.0024892 |
| DOMAIN_3782 | Rhesus | 367 | 2.3058 | 0.0048669 |
| DOMAIN_3803 | Rhesus | 368 | 3.0165 | 0.0083941 |
| DOMAIN_3832 | Rhesus | 369 | 2.7334 | 0.0026058 |
| DOMAIN_4030 | Rhesus | 370 | 2.5274 | 0.0038526 |
| DOMAIN_4036 | Rhesus | 371 | 2.7725 | 0.001577 |
| DOMAIN_4046 | Rhesus | 372 | 2.7847 | 0.0088564 |
| DOMAIN_4120 | Rhesus | 373 | 3.3237 | 4.55E−05 |
| DOMAIN_4121 | Rhesus | 374 | 3.3195 | 1.53E−07 |
| DOMAIN_4126 | Rhesus | 375 | 3.529 | 1.65E−04 |
| DOMAIN_4129 | Rhesus | 376 | 3.7382 | 9.33E−04 |
| DOMAIN_4184 | Rhesus | 377 | 3.2397 | 9.40E−04 |
| DOMAIN_4185 | Rhesus | 378 | 2.9116 | 0.0032623 |
| DOMAIN_4199 | Rhesus | 379 | 2.6844 | 0.0058444 |
| DOMAIN_4239 | Rhesus | 380 | 4.4187 | 9.19E−07 |
| DOMAIN_4394 | Marmoset | 381 | 3.8103 | 4.09E−05 |
| DOMAIN_4425 | Marmoset | 382 | 2.9741 | 0.0087646 |
| DOMAIN_4461 | Marmoset | 383 | 3.0094 | 0.0076595 |
| DOMAIN_4463 | Marmoset | 384 | 2.9717 | 0.008252 |
| DOMAIN_4515 | Marmoset | 385 | 4.2166 | 1.21E−05 |
| DOMAIN_4516 | Marmoset | 386 | 2.7603 | 0.0027577 |
| DOMAIN_4534 | Marmoset | 387 | 2.6242 | 0.0034292 |
| DOMAIN_4574 | Marmoset | 388 | 2.7135 | 9.16E−04 |
| DOMAIN_4580 | Marmoset | 389 | 2.9618 | 3.22E−06 |
| DOMAIN_4589 | Marmoset | 390 | 2.507 | 0.0070104 |
| DOMAIN_4665 | Marmoset | 391 | 3.2985 | 0.0011116 |
| DOMAIN_4705 | Marmoset | 392 | 3.5232 | 5.02E−04 |
| DOMAIN_4722 | Marmoset | 393 | 4.8639 | 1.53E−07 |
| DOMAIN_4748 | Marmoset | 394 | 3.0477 | 5.73E−04 |
| DOMAIN_4749 | Marmoset | 395 | 3.5545 | 2.83E−05 |
| DOMAIN_4751 | Marmoset | 396 | 3.238 | 4.91E−05 |
| DOMAIN_4774 | Marmoset | 397 | 2.8894 | 0.0029528 |
| DOMAIN_4823 | Marmoset | 398 | 2.7527 | 0.0083334 |
| DOMAIN_4913 | Marmoset | 399 | 2.8878 | 0.0028098 |
| DOMAIN_4921 | Marmoset | 400 | 3.5291 | 4.44E−06 |
| DOMAIN_4922 | Marmoset | 401 | 4.0258 | 1.82E−05 |
| DOMAIN_4978 | Marmoset | 402 | 2.7787 | 0.0025526 |
| DOMAIN_5005 | Marmoset | 403 | 2.8406 | 0.00183 |
| DOMAIN_5006 | Marmoset | 404 | 3.8614 | 1.38E−06 |
| DOMAIN_5029 | Marmoset | 405 | 2.2642 | 0.0022609 |
| DOMAIN_5031 | Marmoset | 406 | 2.8605 | 0.0025559 |
| DOMAIN_5060 | Marmoset | 407 | 2.6043 | 8.74E−04 |
| DOMAIN_5096 | Marmoset | 408 | 2.456 | 0.008963 |
| DOMAIN_5099 | Marmoset | 409 | 3.1407 | 0.0021138 |
| DOMAIN_5102 | Marmoset | 410 | 2.7241 | 0.0024099 |
| DOMAIN_5103 | Marmoset | 411 | 2.1016 | 0.0093552 |
| DOMAIN_5125 | Marmoset | 412 | 2.911 | 0.0015369 |
| DOMAIN_5188 | OwlMonkey | 413 | 2.1842 | 0.0046295 |
| DOMAIN_5201 | OwlMonkey | 414 | 3.3658 | 1.53E−07 |
| DOMAIN_5217 | OwlMonkey | 415 | 2.4689 | 0.0031316 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_5235 | OwlMonkey | 416 | 3.437 | 4.62E−04 |
| DOMAIN_5246 | OwlMonkey | 417 | 2.7473 | 0.0042075 |
| DOMAIN_5248 | OwlMonkey | 418 | 4.1052 | 1.53E−07 |
| DOMAIN_5267 | OwlMonkey | 419 | 3.1247 | 0.0016383 |
| DOMAIN_5273 | OwlMonkey | 420 | 2.4023 | 0.0069063 |
| DOMAIN_5299 | OwlMonkey | 421 | 2.7399 | 0.0093892 |
| DOMAIN_5337 | OwlMonkey | 422 | 3.7616 | 4.52E−05 |
| DOMAIN_5370 | OwlMonkey | 423 | 3.0452 | 0.0088803 |
| DOMAIN_5440 | OwlMonkey | 424 | 2.7871 | 0.0048658 |
| DOMAIN_5485 | OwlMonkey | 425 | 2.7826 | 0.0080202 |
| DOMAIN_5489 | OwlMonkey | 426 | 2.6774 | 0.0021808 |
| DOMAIN_5518 | OwlMonkey | 427 | 2.8542 | 0.0030235 |
| DOMAIN_5527 | OwlMonkey | 428 | 3.1092 | 0.0016793 |
| DOMAIN_5603 | OwlMonkey | 429 | 3.2806 | 0.0015418 |
| DOMAIN_5716 | OwlMonkey | 430 | 3.0606 | 5.36E−04 |
| DOMAIN_5742 | *Homo sapiens* | 431 | 2.8617 | 0.0029913 |
| DOMAIN_5765 | *Rattus norvegicus* | 432 | 4.2973 | 1.53E−07 |
| DOMAIN_5774 | *Homo sapiens* | 433 | 2.9608 | 3.75E−05 |
| DOMAIN_5782 | *Homo sapiens* | 434 | 2.9086 | 4.56E−04 |
| DOMAIN_5791 | *Homo sapiens* | 435 | 2.6823 | 0.0051494 |
| DOMAIN_5792 | *Homo sapiens* | 436 | 3.0218 | 8.56E−04 |
| DOMAIN_5806 | *Homo sapiens* | 437 | 2.866 | 0.0037801 |
| DOMAIN_5822 | *Homo sapiens* | 438 | 2.9335 | 0.0074467 |
| DOMAIN_5843 | *Homo sapiens* | 439 | 3.1821 | 2.83E−05 |
| DOMAIN_5866 | *Homo sapiens* | 440 | 2.6362 | 0.0080677 |
| DOMAIN_5883 | *Homo sapiens* | 441 | 3.0097 | 5.52E−04 |
| DOMAIN_5896 | *Bos taurus* | 442 | 2.9429 | 0.0023166 |
| DOMAIN_5901 | *Homo sapiens* | 443 | 3.2935 | 0.0012981 |
| DOMAIN_5914 | *Homo sapiens* | 444 | 2.5527 | 0.0029099 |
| DOMAIN_5921 | *Homo sapiens* | 445 | 2.4715 | 0.00101 |
| DOMAIN_5943 | *Mus musculus* | 446 | 2.501 | 0.0027917 |
| DOMAIN_5946 | *Homo sapiens* | 447 | 3.2998 | 1.38E−06 |
| DOMAIN_5968 | *Bos taurus* | 448 | 3.2856 | 3.86E−04 |
| DOMAIN_5984 | *Homo sapiens* | 449 | 2.9852 | 2.37E−04 |
| DOMAIN_5989 | *Mus musculus* | 450 | 3.6632 | 9.30E−04 |
| DOMAIN_5994 | Orangutan | 451 | 2.9214 | 5.04E−04 |
| DOMAIN_6038 | *Homo sapiens* | 452 | 3.3315 | 2.59E−04 |
| DOMAIN_6053 | Orangutan | 453 | 3.2566 | 1.21E−04 |
| DOMAIN_6063 | *Homo sapiens* | 454 | 3.5653 | 0.0019059 |
| DOMAIN_6078 | *Homo sapiens* | 455 | 2.6246 | 0.0075453 |
| DOMAIN_6134 | *Homo sapiens* | 456 | 2.7081 | 0.0034203 |
| DOMAIN_6169 | *Homo sapiens* | 457 | 3.3909 | 1.68E−06 |
| DOMAIN_6172 | *Homo sapiens* | 458 | 3.883 | 1.07E−06 |
| DOMAIN_6249 | *Saimiri boliviensis boliviensis* | 459 | 3.5469 | 4.44E−06 |
| DOMAIN_6293 | *Rattus norvegicus* | 460 | 2.6707 | 0.0034812 |
| DOMAIN_6354 | *Terrapene carolina triunguis* | 461 | 2.4812 | 0.0095055 |
| DOMAIN_6356 | *Terrapene carolina triunguis* | 462 | 2.9197 | 0.0031965 |
| DOMAIN_6382 | *Gopherus agassizii* | 463 | 3.2875 | 1.66E−04 |
| DOMAIN_6398 | *Gopherus agassizii* | 464 | 2.8238 | 0.0059966 |
| DOMAIN_6410 | *Podarcis muralis* | 465 | 2.7633 | 0.0034243 |
| DOMAIN_6433 | *Podarcis muralis* | 466 | 3.0313 | 1.16E−04 |
| DOMAIN_6458 | *Gopherus agassizii* | 467 | 2.8973 | 0.0048435 |
| DOMAIN_6472 | *Alligator sinensis* | 468 | 2.9259 | 0.0052565 |
| DOMAIN_6482 | *Paroedura picta* | 469 | 3.3106 | 0.0019705 |
| DOMAIN_6501 | *Paroedura picta* | 470 | 3.4172 | 0.0010204 |
| DOMAIN_6539 | *Paroedura picta* | 471 | 3.2371 | 0.0025654 |
| DOMAIN_6555 | *Paroedura picta* | 472 | 3.534 | 4.92E−04 |
| DOMAIN_6577 | *Terrapene carolina triunguis* | 473 | 3.3168 | 3.95E−04 |
| DOMAIN_6595 | *Terrapene carolina triunguis* | 474 | 2.2407 | 0.0027133 |
| DOMAIN_6599 | *Terrapene carolina triunguis* | 475 | 3.3653 | 4.49E−05 |
| DOMAIN_6697 | *Podarcis muralis* | 476 | 2.6712 | 7.35E−04 |
| DOMAIN_6737 | *Microcaecilia unicolor* | 477 | 2.4861 | 0.0065704 |
| DOMAIN_6738 | *Microcaecilia unicolor* | 478 | 2.9275 | 7.79E−04 |
| DOMAIN_6741 | *Microcaecilia unicolor* | 479 | 3.5726 | 2.50E−04 |
| DOMAIN_6866 | *Alligator mississippiensis* | 480 | 3.5825 | 1.02E−04 |
| DOMAIN_6936 | *Callipepla squamata* | 481 | 3.5294 | 9.07E−04 |
| DOMAIN_6938 | *Alligator mississippiensis* | 482 | 2.6093 | 0.0020584 |
| DOMAIN_6952 | *Alligator mississippiensis* | 483 | 2.3403 | 0.0084774 |
| DOMAIN_6970 | *Phasianus colchicus* | 484 | 3.343 | 3.02E−04 |
| DOMAIN_7000 | *Phasianus colchicus* | 485 | 2.8279 | 0.0039843 |
| DOMAIN_7098 | *Microcaecilia unicolor* | 486 | 2.7074 | 0.0030553 |
| DOMAIN_7109 | *Microcaecilia unicolor* | 487 | 2.9932 | 0.0077318 |
| DOMAIN_7123 | *Microcaecilia unicolor* | 488 | 2.9074 | 0.0043723 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_7166 | *Microcaecilia unicolor* | 489 | 3.1419 | 5.72E−04 |
| DOMAIN_7183 | *Microcaecilia unicolor* | 490 | 2.4918 | 1.27E−04 |
| DOMAIN_7184 | *Microcaecilia unicolor* | 491 | 2.2019 | 0.0099168 |
| DOMAIN_7328 | *Terrapene carolina triunguis* | 492 | 3.1808 | 5.04E−05 |
| DOMAIN_7353 | *Microcaecilia unicolor* | 493 | 2.6649 | 0.0042219 |
| DOMAIN_7365 | *Microcaecilia unicolor* | 494 | 2.597 | 0.0042403 |
| DOMAIN_7480 | *Gopherus agassizii* | 495 | 3.1707 | 5.44E−04 |
| DOMAIN_7510 | *Gopherus agassizii* | 496 | 3.0452 | 6.73E−04 |
| DOMAIN_7534 | *Gopherus agassizii* | 497 | 3.4086 | 2.50E−04 |
| DOMAIN_7553 | *Gopherus agassizii* | 498 | 2.9036 | 0.0088341 |
| DOMAIN_7605 | *Alligator sinensis* | 499 | 2.8444 | 0.0018789 |
| DOMAIN_7607 | *Alligator sinensis* | 500 | 2.7102 | 0.0018612 |
| DOMAIN_7641 | *Gallus gallus* | 501 | 3.6727 | 4.51E−04 |
| DOMAIN_7653 | *Gallus gallus* | 502 | 3.3772 | 0.0028364 |
| DOMAIN_7678 | *Chelonia mydas* | 503 | 2.7348 | 0.0039197 |
| DOMAIN_7711 | *Columba livia* | 504 | 3.7965 | 1.67E−05 |
| DOMAIN_7716 | *Pogona vitticeps* | 505 | 3.1171 | 0.0011931 |
| DOMAIN_7745 | *Meleagris gallopavo* | 506 | 3.4946 | 0.0016126 |
| DOMAIN_7750 | *Columba livia* | 507 | 2.8111 | 0.0012249 |
| DOMAIN_7774 | *Pogona vitticeps* | 508 | 3.427 | 8.09E−04 |
| DOMAIN_7796 | *Chelonia mydas* | 509 | 2.9513 | 1.04E−04 |
| DOMAIN_7813 | *Columba livia* | 510 | 3.4645 | 7.95E−04 |
| DOMAIN_7824 | *Columba livia* | 511 | 2.9383 | 5.45E−04 |
| DOMAIN_7850 | *Terrapene carolina triunguis* | 512 | 3.124 | 5.15E−04 |
| DOMAIN_7895 | *Patagioenas fasciata monilis* | 513 | 3.2254 | 0.0013863 |
| DOMAIN_7925 | *Gallus gallus* | 514 | 3.3919 | 0.0025195 |
| DOMAIN_8012 | *Callipepla squamata* | 515 | 3.2046 | 0.0023734 |
| DOMAIN_8013 | *Callipepla squamata* | 516 | 3.9783 | 2.13E−05 |
| DOMAIN_8014 | *Callipepla squamata* | 517 | 3.7425 | 6.23E−05 |
| DOMAIN_8036 | *Alligator mississippiensis* | 518 | 2.3504 | 0.0094483 |
| DOMAIN_8041 | *Dipodomys ordii* | 519 | 3.6568 | 3.47E−04 |
| DOMAIN_8054 | *Cavia porcellus* | 520 | 3.5889 | 4.15E−05 |
| DOMAIN_8148 | *Cricetulus griseus* | 521 | 3.6904 | 4.82E−05 |
| DOMAIN_8151 | *Cricetulus griseus* | 522 | 3.1527 | 0.0034782 |
| DOMAIN_8154 | *Cricetulus griseus* | 523 | 2.8774 | 0.0027807 |
| DOMAIN_8167 | *Mus musculus* | 524 | 3.9362 | 1.04E−04 |
| DOMAIN_8179 | *Mesocricetus auratus* | 525 | 3.0623 | 0.0026242 |
| DOMAIN_8182 | *Mus caroli* | 526 | 2.2411 | 0.0018051 |
| DOMAIN_8216 | *Cricetulus griseus* | 527 | 3.1747 | 9.05E−05 |
| DOMAIN_8226 | *Rattus norvegicus* | 528 | 2.4602 | 0.0090772 |
| DOMAIN_8235 | *Mus caroli* | 529 | 2.8965 | 0.0012522 |
| DOMAIN_8282 | *Peromyscus maniculatus bairdii* | 530 | 3.9882 | 1.07E−06 |
| DOMAIN_8289 | *Peromyscus maniculatus bairdii* | 531 | 3.3026 | 2.94E−04 |
| DOMAIN_8301 | *Mesocricetus auratus* | 532 | 3.1084 | 0.0017647 |
| DOMAIN_8303 | *Ictidomys tridecemlineatus* | 533 | 3.6843 | 1.34E−04 |
| DOMAIN_8305 | *Ictidomys tridecemlineatus* | 534 | 2.5554 | 0.0084633 |
| DOMAIN_8308 | *Marmota monax* | 535 | 2.6564 | 3.69E−04 |
| DOMAIN_8317 | *Mus caroli* | 536 | 3.3091 | 2.40E−05 |
| DOMAIN_8340 | *Peromyscus maniculatus bairdii* | 537 | 2.2764 | 0.0086378 |
| DOMAIN_8353 | *Peromyscus maniculatus bairdii* | 538 | 2.7989 | 4.14E−04 |
| DOMAIN_8370 | *Cavia porcellus* | 539 | 3.5737 | 2.58E−04 |
| DOMAIN_8412 | *Mus musculus* | 540 | 2.4486 | 0.0077639 |
| DOMAIN_8418 | *Cricetulus griseus* | 541 | 2.4014 | 0.001307 |
| DOMAIN_8424 | *Peromyscus maniculatus bairdii* | 542 | 2.7945 | 0.0019818 |
| DOMAIN_8425 | *Peromyscus maniculatus bairdii* | 543 | 2.8391 | 0.004804 |
| DOMAIN_8460 | *Peromyscus maniculatus bairdii* | 544 | 3.1352 | 6.66E−05 |
| DOMAIN_8467 | *Mesocricetus auratus* | 545 | 3.8156 | 7.15E−05 |
| DOMAIN_8489 | *Mus caroli* | 546 | 2.8336 | 0.0042299 |
| DOMAIN_8492 | *Mus musculus* | 547 | 3.3107 | 0.0032374 |
| DOMAIN_8502 | *Cricetulus griseus* | 548 | 2.1429 | 4.22E−04 |
| DOMAIN_8545 | *Rattus norvegicus* | 549 | 3.1044 | 0.0011282 |
| DOMAIN_8546 | *Mus musculus* | 550 | 2.9439 | 0.0033958 |
| DOMAIN_8547 | *Mus caroli* | 551 | 3.3997 | 0.0022286 |
| DOMAIN_8549 | *Mus caroli* | 552 | 2.8508 | 0.0052033 |
| DOMAIN_8555 | *Cricetulus griseus* | 553 | 3.2852 | 5.62E−05 |
| DOMAIN_8618 | *Mesocricetus auratus* | 554 | 2.6363 | 0.008293 |
| DOMAIN_8688 | *Mus musculus* | 555 | 2.4409 | 2.00E−04 |
| DOMAIN_8689 | *Mus musculus* | 556 | 2.8548 | 6.62E−04 |
| DOMAIN_8712 | *Mesocricetus auratus* | 557 | 2.7776 | 0.0028768 |
| DOMAIN_8742 | *Peromyscus maniculatus bairdii* | 558 | 2.3354 | 0.002149 |
| DOMAIN_8746 | *Mesocricetus auratus* | 559 | 3.317 | 1.64E−04 |
| DOMAIN_8789 | *Marmota monax* | 560 | 3.1756 | 0.0021937 |
| DOMAIN_8793 | *Mus caroli* | 561 | 2.6774 | 9.60E−05 |

TABLE 54-continued

List of 1,597 repressor domain candidates identified from the high-throughput screen assessing dXR repression of the HBEGF gene and subsequent application of the following criteria: p-value <0.01 and $\log_2$(fold change) >2

| Domain ID | Species | SEQ ID NO | Log2 (fold change) | P-value |
|---|---|---|---|---|
| DOMAIN_8816 | *Peromyscus maniculatus bairdii* | 562 | 2.4156 | 2.32E−04 |
| DOMAIN_8830 | *Cavia porcellus* | 563 | 3.0644 | 0.0025588 |
| DOMAIN_8839 | *Peromyscus maniculatus bairdii* | 564 | 3.0637 | 0.0036542 |
| DOMAIN_8844 | *Peromyscus maniculatus bairdii* | 565 | 4.1629 | 7.81E−06 |
| DOMAIN_8850 | *Peromyscus maniculatus bairdii* | 566 | 2.695 | 0.0040575 |
| DOMAIN_8862 | *Marmota monax* | 567 | 2.3521 | 0.0061537 |
| DOMAIN_8881 | *Cricetulus griseus* | 568 | 3.743 | 1.49E−05 |
| DOMAIN_8886 | *Cricetulus griseus* | 569 | 3.5727 | 1.94E−05 |
| DOMAIN_8899 | *Mesocricetus auratus* | 570 | 3.2182 | 9.45E−05 |
| DOMAIN_8931 | *Cricetulus griseus* | 571 | 2.9497 | 8.73E−04 |
| DOMAIN_8936 | *Cricetulus griseus* | 572 | 4.3486 | 1.07E−06 |
| DOMAIN_8953 | *Mus caroli* | 573 | 2.5941 | 0.0032969 |
| DOMAIN_8982 | *Mesocricetus auratus* | 574 | 3.1585 | 3.54E−05 |
| DOMAIN_8989 | *Marmota monax* | 575 | 2.2309 | 0.0094553 |
| DOMAIN_9012 | *Mus musculus* | 576 | 2.3905 | 0.0070058 |
| DOMAIN_9042 | *Mus caroli* | 577 | 2.5894 | 0.0033885 |
| DOMAIN_9060 | *Cricetulus griseus* | 578 | 2.5974 | 0.0027286 |
| DOMAIN_9119 | *Mesocricetus auratus* | 579 | 2.2985 | 0.0052412 |
| DOMAIN_9141 | *Mus caroli* | 580 | 3.035 | 2.62E−05 |
| DOMAIN_9159 | *Dipodomys ordii* | 581 | 3.0141 | 0.0023052 |
| DOMAIN_9174 | *Peromyscus maniculatus bairdii* | 582 | 2.5194 | 0.0035749 |
| DOMAIN_9175 | *Peromyscus maniculatus bairdii* | 583 | 2.4231 | 0.0042293 |
| DOMAIN_9189 | *Heterocephalus glaber* | 584 | 3.3801 | 1.76E−04 |
| DOMAIN_9192 | *Mus caroli* | 585 | 2.7981 | 0.008526 |
| DOMAIN_9217 | *Mesocricetus auratus* | 586 | 3.8919 | 5.43E−05 |
| DOMAIN_9235 | *Mus musculus* | 587 | 2.7307 | 0.0035899 |
| DOMAIN_9250 | *Marmota monax* | 588 | 3.466 | 0.0012007 |
| DOMAIN_9265 | *Mus musculus* | 589 | 2.1221 | 0.0021172 |
| DOMAIN_9290 | *Peromyscus maniculatus bairdii* | 590 | 4.256 | 1.07E−06 |
| DOMAIN_9303 | *Marmota monax* | 591 | 2.5344 | 0.0051732 |
| DOMAIN_9313 | *Mus musculus* | 592 | 2.7692 | 0.0061916 |
| DOMAIN_9324 | *Peromyscus maniculatus bairdii* | 593 | 3.1782 | 0.0020198 |
| DOMAIN_9329 | *Peromyscus maniculatus bairdii* | 594 | 4.263 | 7.81E−06 |
| DOMAIN_9332 | *Peromyscus maniculatus bairdii* | 595 | 3.9002 | 1.38E−06 |
| DOMAIN_9356 | *Ictidomys tridecemlineatus* | 596 | 2.9297 | 0.0037302 |
| DOMAIN_9389 | *Marmota monax* | 597 | 3.1785 | 2.65E−05 |
| DOMAIN_9424 | *Dipodomys ordii* | 598 | 3.771 | 1.53E−07 |
| DOMAIN_9435 | *Fukomys damarensis* | 599 | 3.1672 | 3.01E−04 |
| DOMAIN_9446 | *Marmota monax* | 600 | 2.8722 | 3.80E−04 |
| DOMAIN_9489 | *Dipodomys ordii* | 601 | 3.0215 | 0.0074336 |
| DOMAIN_9503 | *Ictidomys tridecemlineatus* | 602 | 2.9864 | 0.0021536 |
| DOMAIN_9526 | *Mesocricetus auratus* | 603 | 2.9435 | 0.0042492 |
| DOMAIN_9530 | *Mesocricetus auratus* | 604 | 2.7003 | 0.0026178 |
| DOMAIN_9541 | *Dipodomys ordii* | 605 | 2.8442 | 0.0028404 |
| DOMAIN_9542 | *Octodon degus* | 606 | 2.6734 | 0.0036809 |
| DOMAIN_9544 | *Octodon degus* | 607 | 2.9143 | 0.0054966 |
| DOMAIN_9559 | *Mus caroli* | 608 | 3.327 | 0.001653 |
| DOMAIN_9563 | *Mus musculus* | 609 | 3.7261 | 3.81E−05 |
| DOMAIN_9576 | *Octodon degus* | 610 | 2.1952 | 0.0094564 |
| DOMAIN_9617 | *Mesocricetus auratus* | 611 | 2.4034 | 0.0040152 |
| DOMAIN_9643 | *Dipodomys ordii* | 612 | 3.4306 | 0.0023603 |
| DOMAIN_9697 | *Octodon degus* | 613 | 2.7566 | 0.0063579 |
| DOMAIN_9704 | *Dipodomys ordii* | 614 | 3.1674 | 0.0013462 |
| DOMAIN_9706 | *Octodon degus* | 615 | 2.821 | 0.0041809 |
| DOMAIN_9713 | *Cricetulus griseus* | 616 | 3.0323 | 0.002243 |
| DOMAIN_9716 | *Mus caroli* | 617 | 2.9009 | 0.0040762 |
| DOMAIN_9723 | *Mus caroli* | 618 | 2.1903 | 0.0058971 |
| DOMAIN_9725 | *Mus caroli* | 619 | 2.9654 | 0.0028095 |
| DOMAIN_9776 | *Marmota monax* | 620 | 2.6258 | 0.0084697 |
| DOMAIN_9787 | *Mus caroli* | 621 | 3.2962 | 8.37E−05 |
| DOMAIN_9789 | *Mus musculus* | 622 | 2.5801 | 0.0012534 |
| DOMAIN_9822 | *Ictidomys tridecemlineatus* | 623 | 2.9382 | 0.0065879 |
| DOMAIN_9824 | *Heterocephalus glaber* | 624 | 3.1306 | 8.34E−05 |
| DOMAIN_9827 | *Mus caroli* | 625 | 2.1904 | 0.0077554 |
| DOMAIN_9843 | *Mus musculus* | 626 | 2.3385 | 0.0035982 |
| DOMAIN_9846 | *Cricetulus griseus* | 627 | 2.7865 | 0.0025033 |
| DOMAIN_9857 | *Mesocricetus auratus* | 628 | 3.3666 | 8.92E−04 |
| DOMAIN_9858 | *Mesocricetus auratus* | 629 | 3.0047 | 1.33E−04 |
| DOMAIN_9878 | *Marmota monax* | 630 | 3.7349 | 2.61E−04 |
| DOMAIN_9891 | *Mus caroli* | 631 | 2.8116 | 3.13E−04 |
| DOMAIN_9915 | *Mus caroli* | 632 | 3.4011 | 3.45E−04 |
| DOMAIN_9962 | *Rattus norvegicus* | 633 | 2.7249 | 0.004063 |
| DOMAIN_9993 | *Rattus norvegicus* | 634 | 2.7601 | 0.0035973 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_10018 | *Octodon degus* | 635 | 3.3372 | 4.27E−04 |
| DOMAIN_10041 | *Mus caroli* | 636 | 2.8662 | 0.0062437 |
| DOMAIN_10044 | *Mus musculus* | 637 | 2.826 | 0.0043095 |
| DOMAIN_10050 | *Octodon degus* | 638 | 3.3147 | 0.0020066 |
| DOMAIN_10057 | *Mus musculus* | 639 | 2.2961 | 0.0026799 |
| DOMAIN_10091 | *Fukomys damarensis* | 640 | 2.1679 | 4.36E−04 |
| DOMAIN_10127 | *Peromyscus maniculatus bairdii* | 641 | 3.6912 | 3.83E−06 |
| DOMAIN_10160 | *Ictidomys tridecemlineatus* | 642 | 2.9333 | 4.23E−04 |
| DOMAIN_10184 | *Mus caroli* | 643 | 4.2854 | 1.53E−07 |
| DOMAIN_10241 | *Octodon degus* | 644 | 3.5766 | 8.19E−05 |
| DOMAIN_10257 | *Octodon degus* | 645 | 3.1757 | 5.20E−04 |
| DOMAIN_10294 | *Mus musculus* | 646 | 2.689 | 0.0067073 |
| DOMAIN_10334 | *Mustela putorius furo* | 647 | 3.3529 | 5.07E−05 |
| DOMAIN_10351 | *Delphinapterus leucas* | 648 | 3.3309 | 3.78E−04 |
| DOMAIN_10359 | *Delphinapterus leucas* | 649 | 2.9199 | 0.0036842 |
| DOMAIN_10381 | *Vicugna pacos* | 650 | 2.215 | 0.0057838 |
| DOMAIN_10386 | *Odobenus rosmarus divergens* | 651 | 2.8337 | 0.0028753 |
| DOMAIN_10403 | *Vicugna pacos* | 652 | 3.3993 | 0.0016441 |
| DOMAIN_10420 | *Odobenus rosmarus divergens* | 653 | 3.7185 | 1.01E−04 |
| DOMAIN_10425 | *Delphinapterus leucas* | 654 | 2.8616 | 0.0041775 |
| DOMAIN_10427 | *Carlito syrichta* | 655 | 2.3719 | 0.0078328 |
| DOMAIN_10491 | *Vicugna pacos* | 656 | 3.7199 | 0.0012761 |
| DOMAIN_10495 | *Delphinapterus leucas* | 657 | 3.4705 | 5.27E−04 |
| DOMAIN_10526 | *Delphinapterus leucas* | 658 | 2.4499 | 0.0033355 |
| DOMAIN_10573 | *Cervus elaphus hippelaphus* | 659 | 2.4077 | 5.02E−04 |
| DOMAIN_10612 | *Vicugna pacos* | 660 | 2.4997 | 0.0035134 |
| DOMAIN_10613 | *Odobenus rosmarus divergens* | 661 | 2.9148 | 5.62E−05 |
| DOMAIN_10623 | *Carlito syrichta* | 662 | 3.2233 | 0.0018333 |
| DOMAIN_10646 | *Delphinapterus leucas* | 663 | 2.9354 | 0.0036496 |
| DOMAIN_10647 | *Delphinapterus leucas* | 664 | 2.9514 | 7.60E−04 |
| DOMAIN_10675 | *Ornithorhynchus anatinus* | 665 | 3.2777 | 5.13E−05 |
| DOMAIN_10684 | *Odobenus rosmarus divergens* | 666 | 4.531 | 1.64E−05 |
| DOMAIN_10704 | *Colobus angolensis palliatus* | 667 | 3.1582 | 0.004292 |
| DOMAIN_10705 | *Colobus angolensis palliatus* | 668 | 3.6392 | 4.09E−05 |
| DOMAIN_10733 | *Odobenus rosmarus divergens* | 669 | 3.315 | 0.0028523 |
| DOMAIN_10762 | *Erinaceus europaeus* | 670 | 3.9254 | 4.55E−05 |
| DOMAIN_10763 | *Mustela putorius furo* | 671 | 2.5924 | 0.0073193 |
| DOMAIN_10765 | *Mustela putorius furo* | 672 | 2.5661 | 0.0076445 |
| DOMAIN_10807 | *Erinaceus europaeus* | 673 | 3.5237 | 1.54E−04 |
| DOMAIN_10882 | *Vicugna pacos* | 674 | 3.6289 | 2.93E−04 |
| DOMAIN_10902 | *Vicugna pacos* | 675 | 3.1052 | 0.0096752 |
| DOMAIN_10917 | *Odobenus rosmarus divergens* | 676 | 3.7871 | 1.53E−07 |
| DOMAIN_10943 | *Cervus elaphus hippelaphus* | 677 | 2.5554 | 0.0037715 |
| DOMAIN_10974 | *Chelonia mydas* | 678 | 2.6444 | 0.0091318 |
| DOMAIN_11006 | *Loxodonta africana* | 679 | 2.6669 | 6.71E−04 |
| DOMAIN_11024 | *Suricata suricatta* | 680 | 3.2397 | 2.77E−04 |
| DOMAIN_11031 | *Mandrillus leucophaeus* | 681 | 2.5516 | 0.005857 |
| DOMAIN_11034 | *Mandrillus leucophaeus* | 682 | 2.2541 | 0.0042161 |
| DOMAIN_11040 | *Sus scrofa* | 683 | 3.5161 | 3.39E−04 |
| DOMAIN_11049 | *Neophocaena asiaeorientalis asiaeorientalis* | 684 | 2.7072 | 0.0015299 |
| DOMAIN_11053 | *Nomascus leucogenys* | 685 | 3.677 | 4.44E−06 |
| DOMAIN_11069 | *Capra hircus* | 686 | 3.2745 | 0.0036948 |
| DOMAIN_11071 | *Chrysochloris asiatica* | 687 | 3.1268 | 0.0012421 |
| DOMAIN_11097 | *Mandrillus leucophaeus* | 688 | 3.239 | 0.0011508 |
| DOMAIN_11110 | *Sus scrofa* | 689 | 3.6632 | 4.76E−04 |
| DOMAIN_11129 | *Nomascus leucogenys* | 690 | 2.3864 | 1.88E−04 |
| DOMAIN_11130 | *Nomascus leucogenys* | 691 | 2.3487 | 6.64E−04 |
| DOMAIN_11132 | *Bos indicus* | 692 | 3.5671 | 3.08E−05 |
| DOMAIN_11157 | *Suricata suricatta* | 693 | 3.6671 | 8.22E−05 |
| DOMAIN_11158 | *Chrysochloris asiatica* | 694 | 2.6889 | 0.0035388 |
| DOMAIN_11162 | *Mandrillus leucophaeus* | 695 | 3.2804 | 2.65E−04 |
| DOMAIN_11178 | *Sus scrofa* | 696 | 2.4845 | 0.0043413 |
| DOMAIN_11192 | *Neophocaena asiaeorientalis asiaeorientalis* | 697 | 2.8798 | 2.10E−04 |
| DOMAIN_11202 | *Nomascus leucogenys* | 698 | 3.5851 | 4.18E−05 |
| DOMAIN_11204 | *Nomascus leucogenys* | 699 | 3.5793 | 5.22E−05 |
| DOMAIN_11225 | *Capra hircus* | 700 | 3.606 | 0.0011566 |
| DOMAIN_11227 | *Capra hircus* | 701 | 2.7556 | 0.0032733 |
| DOMAIN_11264 | *Sus scrofa* | 702 | 3.5019 | 5.64E−04 |
| DOMAIN_11265 | *Sus scrofa* | 703 | 4.2521 | 1.53E−07 |
| DOMAIN_11282 | *Suricata suricatta* | 704 | 3.536 | 1.53E−07 |
| DOMAIN_11289 | *Suricata suricatta* | 705 | 2.69 | 2.48E−04 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_11291 | *Suricata suricatta* | 706 | 4.0373 | 4.59E−07 |
| DOMAIN_11307 | *Mandrillus leucophaeus* | 707 | 3.6383 | 1.07E−06 |
| DOMAIN_11312 | *Sus scrofa* | 708 | 3.8532 | 9.26E−05 |
| DOMAIN_11314 | *Sus scrofa* | 709 | 2.9575 | 0.0015357 |
| DOMAIN_11321 | *Nomascus leucogenys* | 710 | 2.9718 | 0.0086853 |
| DOMAIN_11331 | *Capra hircus* | 711 | 3.0611 | 4.37E−04 |
| DOMAIN_11332 | *Capra hircus* | 712 | 3.0468 | 2.19E−04 |
| DOMAIN_11356 | *Sus scrofa* | 713 | 2.6549 | 0.0027629 |
| DOMAIN_11359 | *Sus scrofa* | 714 | 3.1036 | 0.0092232 |
| DOMAIN_11381 | *Nomascus leucogenys* | 715 | 3.1705 | 4.83E−04 |
| DOMAIN_11393 | *Suricata suricatta* | 716 | 3.4256 | 1.65E−04 |
| DOMAIN_11401 | *Suricata suricatta* | 717 | 2.6345 | 0.0077459 |
| DOMAIN_11403 | *Suricata suricatta* | 718 | 3.4222 | 2.27E−04 |
| DOMAIN_11413 | *Sus scrofa* | 719 | 2.1814 | 0.0084919 |
| DOMAIN_11433 | *Neophocaena asiaeorientalis asiaeorientalis* | 720 | 3.3986 | 1.91E−05 |
| DOMAIN_11446 | *Nomascus leucogenys* | 721 | 2.6971 | 3.26E−04 |
| DOMAIN_11461 | *Equus caballus* | 722 | 2.508 | 0.0090515 |
| DOMAIN_11466 | *Suricata suricatta* | 723 | 3.4716 | 0.0027896 |
| DOMAIN_11470 | *Mandrillus leucophaeus* | 724 | 3.1038 | 0.0012895 |
| DOMAIN_11502 | *Trichechus manatus latirostris* | 725 | 3.601 | 4.21E−05 |
| DOMAIN_11505 | *Trichechus manatus latirostris* | 726 | 3.0969 | 9.19E−07 |
| DOMAIN_11534 | *Sus scrofa* | 727 | 3.8118 | 1.91E−05 |
| DOMAIN_11554 | *Nomascus leucogenys* | 728 | 3.0498 | 4.11E−04 |
| DOMAIN_11567 | *Zalophus californianus* | 729 | 3.4239 | 0.0010611 |
| DOMAIN_11581 | *Equus caballus* | 730 | 3.1882 | 4.10E−04 |
| DOMAIN_11612 | *Loxodonta africana* | 731 | 3.3006 | 0.0040119 |
| DOMAIN_11621 | *Chrysochloris asiatica* | 732 | 3.2074 | 5.42E−04 |
| DOMAIN_11643 | *Nomascus leucogenys* | 733 | 2.3544 | 0.0020207 |
| DOMAIN_11662 | *Capra hircus* | 734 | 3.7889 | 2.36E−04 |
| DOMAIN_11672 | *Suricata suricatta* | 735 | 3.318 | 0.0022931 |
| DOMAIN_11701 | *Capra hircus* | 736 | 2.5282 | 0.0084694 |
| DOMAIN_11726 | *Sus scrofa* | 737 | 3.4183 | 1.09E−05 |
| DOMAIN_11749 | *Chlorocebus sabaeus* | 738 | 3.2721 | 0.0023817 |
| DOMAIN_11753 | *Mandrillus leucophaeus* | 739 | 2.6119 | 0.0062269 |
| DOMAIN_11760 | *Neophocaena asiaeorientalis asiaeorientalis* | 740 | 2.8102 | 0.0039794 |
| DOMAIN_11796 | *Sus scrofa* | 741 | 2.2811 | 0.0010219 |
| DOMAIN_11813 | *Canis lupus familiaris* | 742 | 3.5195 | 7.62E−04 |
| DOMAIN_11825 | *Mandrillus leucophaeus* | 743 | 3.9893 | 1.53E−07 |
| DOMAIN_11851 | *Nomascus leucogenys* | 744 | 3.0241 | 1.32E−04 |
| DOMAIN_11858 | *Canis lupus familiaris* | 745 | 3.6419 | 1.53E−07 |
| DOMAIN_11862 | *Canis lupus familiaris* | 746 | 2.8817 | 0.0032412 |
| DOMAIN_11865 | *Muntiacus muntjak* | 747 | 3.0474 | 0.0026931 |
| DOMAIN_11868 | *Mandrillus leucophaeus* | 748 | 3.5158 | 4.44E−06 |
| DOMAIN_11908 | *Canis lupus familiaris* | 749 | 2.894 | 0.0035529 |
| DOMAIN_11923 | *Sus scrofa* | 750 | 3.2271 | 0.0018734 |
| DOMAIN_11925 | *Mandrillus leucophaeus* | 751 | 3.5582 | 3.04E−04 |
| DOMAIN_11928 | *Neophocaena asiaeorientalis asiaeorientalis* | 752 | 3.751 | 7.59E−04 |
| DOMAIN_11933 | *Neophocaena asiaeorientalis asiaeorientalis* | 753 | 4.1135 | 1.52E−05 |
| DOMAIN_11944 | *Bos indicus* | 754 | 3.2762 | 0.0022727 |
| DOMAIN_11950 | *Canis lupus familiaris* | 755 | 4.3869 | 2.91E−06 |
| DOMAIN_11988 | *Muntiacus muntjak* | 756 | 3.5916 | 3.83E−06 |
| DOMAIN_11996 | *Canis lupus familiaris* | 757 | 3.0831 | 0.0015161 |
| DOMAIN_11999 | *Canis lupus familiaris* | 758 | 3.7891 | 5.04E−05 |
| DOMAIN_12001 | *Mandrillus leucophaeus* | 759 | 2.4384 | 0.0057376 |
| DOMAIN_12021 | *Canis lupus familiaris* | 760 | 2.4637 | 0.0018489 |
| DOMAIN_12051 | *Muntiacus muntjak* | 761 | 2.7925 | 0.0039375 |
| DOMAIN_12057 | *Muntiacus muntjak* | 762 | 2.0631 | 0.0086017 |
| DOMAIN_12079 | *Muntiacus muntjak* | 763 | 2.4029 | 0.0095567 |
| DOMAIN_12092 | *Bos mutus* | 764 | 3.1752 | 1.82E−05 |
| DOMAIN_12114 | *Neophocaena asiaeorientalis asiaeorientalis* | 765 | 3.3227 | 6.62E−04 |
| DOMAIN_12133 | *Canis lupus familiaris* | 766 | 3.0204 | 0.0034751 |
| DOMAIN_12139 | *Canis lupus familiaris* | 767 | 2.8097 | 0.0066678 |
| DOMAIN_12147 | *Neophocaena asiaeorientalis asiaeorientalis* | 768 | 2.6974 | 9.14E−04 |
| DOMAIN_12158 | *Nomascus leucogenys* | 769 | 3.0332 | 0.006631 |
| DOMAIN_12187 | *Canis lupus familiaris* | 770 | 3.6477 | 5.13E−05 |
| DOMAIN_12191 | *Muntiacus muntjak* | 771 | 3.6138 | 8.18E−04 |
| DOMAIN_12195 | *Canis lupus familiaris* | 772 | 2.9023 | 1.11E−04 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_12206 | *Bos mutus* | 773 | 2.9101 | 5.13E−04 |
| DOMAIN_12210 | *Bos indicus* | 774 | 3.6136 | 0.0018284 |
| DOMAIN_12214 | *Muntiacus muntjak* | 775 | 2.613 | 9.76E−04 |
| DOMAIN_12231 | *Nomascus leucogenys* | 776 | 2.6703 | 0.00421 |
| DOMAIN_12261 | *Neophocaena asiaeorientalis asiaeorientalis* | 777 | 2.7989 | 0.0029785 |
| DOMAIN_12285 | Gorilla | 778 | 2.2573 | 0.0091023 |
| DOMAIN_12313 | *Bos indicus* | 779 | 2.6903 | 0.0012684 |
| DOMAIN_12320 | *Muntiacus muntjak* | 780 | 2.5075 | 0.0023021 |
| DOMAIN_12365 | *Nomascus leucogenys* | 781 | 3.5626 | 7.78E−04 |
| DOMAIN_12395 | *Ailuropoda melanoleuca* | 782 | 3.1504 | 3.56E−04 |
| DOMAIN_12459 | *Bos indicus* | 783 | 4.0425 | 3.06E−06 |
| DOMAIN_12463 | *Ailuropoda melanoleuca* | 784 | 3.2567 | 0.009339 |
| DOMAIN_12467 | Gorilla | 785 | 2.9575 | 4.85E−04 |
| DOMAIN_12498 | *Muntiacus muntjak* | 786 | 2.8947 | 0.0075569 |
| DOMAIN_12499 | *Muntiacus muntjak* | 787 | 2.2932 | 0.0064341 |
| DOMAIN_12508 | Gorilla | 788 | 3.0173 | 0.0024497 |
| DOMAIN_12511 | Gorilla | 789 | 3.0694 | 0.0023557 |
| DOMAIN_12517 | *Lynx canadensis* | 790 | 2.6983 | 0.0017522 |
| DOMAIN_12544 | Gorilla | 791 | 3.306 | 4.83E−04 |
| DOMAIN_12550 | *Ailuropoda melanoleuca* | 792 | 3.0229 | 2.37E−04 |
| DOMAIN_12576 | Gorilla | 793 | 3.04 | 0.0044151 |
| DOMAIN_12590 | *Bos indicus* | 794 | 2.5531 | 0.0020023 |
| DOMAIN_12591 | *Bos indicus* | 795 | 3.4169 | 0.0011553 |
| DOMAIN_12598 | *Muntiacus muntjak* | 796 | 3.3709 | 4.18E−05 |
| DOMAIN_12599 | *Muntiacus muntjak* | 797 | 2.2098 | 0.007064 |
| DOMAIN_12630 | *Macaca fascicularis* | 798 | 3.6424 | 4.03E−05 |
| DOMAIN_12646 | *Myotis lucifugus* | 799 | 3.487 | 0.0014708 |
| DOMAIN_12686 | *Phascolarctos cinereus* | 800 | 2.76 | 0.0032103 |
| DOMAIN_12698 | *Phascolarctos cinereus* | 801 | 2.8029 | 0.0066675 |
| DOMAIN_12704 | *Myotis lucifugus* | 802 | 2.9127 | 0.0034078 |
| DOMAIN_12712 | *Puma concolor* | 803 | 2.1195 | 0.008023 |
| DOMAIN_12728 | *Lynx canadensis* | 804 | 3.1999 | 9.49E−04 |
| DOMAIN_12734 | *Phyllostomus discolor* | 805 | 3.5207 | 1.38E−06 |
| DOMAIN_12755 | *Oryctolagus cuniculus* | 806 | 2.8082 | 0.0061475 |
| DOMAIN_12764 | *Desmodus rotundus* | 807 | 3.9505 | 1.53E−07 |
| DOMAIN_12769 | *Macaca fascicularis* | 808 | 2.0555 | 0.0080928 |
| DOMAIN_12777 | *Phascolarctos cinereus* | 809 | 2.1778 | 0.0057731 |
| DOMAIN_12780 | *Phascolarctos cinereus* | 810 | 3.2671 | 1.01E−04 |
| DOMAIN_12801 | *Sapajus apella* | 811 | 2.0238 | 0.006988 |
| DOMAIN_12811 | *Macaca fascicularis* | 812 | 2.4278 | 0.0068959 |
| DOMAIN_12815 | *Macaca fascicularis* | 813 | 2.7296 | 0.0029445 |
| DOMAIN_12818 | *Macaca fascicularis* | 814 | 3.6211 | 9.69E−05 |
| DOMAIN_12829 | *Phascolarctos cinereus* | 815 | 3.3994 | 3.20E−04 |
| DOMAIN_12831 | *Phascolarctos cinereus* | 816 | 2.9845 | 0.0029084 |
| DOMAIN_12839 | *Oryctolagus cuniculus* | 817 | 3.4039 | 3.03E−04 |
| DOMAIN_12849 | *Muntiacus muntjak* | 818 | 4.1042 | 1.53E−07 |
| DOMAIN_12896 | *Macaca fascicularis* | 819 | 2.0413 | 0.0010397 |
| DOMAIN_12901 | *Macaca fascicularis* | 820 | 3.5686 | 4.75E−06 |
| DOMAIN_12902 | *Macaca fascicularis* | 821 | 3.3489 | 0.0016432 |
| DOMAIN_12912 | *Puma concolor* | 822 | 2.7422 | 4.78E−04 |
| DOMAIN_12941 | *Phyllostomus discolor* | 823 | 2.4012 | 0.0062382 |
| DOMAIN_12985 | *Phascolarctos cinereus* | 824 | 3.7331 | 3.05E−05 |
| DOMAIN_13004 | *Macaca fascicularis* | 825 | 3.2216 | 1.37E−04 |
| DOMAIN_13022 | *Phascolarctos cinereus* | 826 | 3.0468 | 0.003082 |
| DOMAIN_13029 | *Myotis lucifugus* | 827 | 3.1708 | 3.58E−04 |
| DOMAIN_13062 | *Ursus maritimus* | 828 | 2.9752 | 2.10E−04 |
| DOMAIN_13068 | *Ailuropoda melanoleuca* | 829 | 3.6132 | 2.43E−05 |
| DOMAIN_13089 | *Sapajus apella* | 830 | 2.8761 | 0.0065934 |
| DOMAIN_13111 | *Ailuropoda melanoleuca* | 831 | 2.6151 | 0.0090675 |
| DOMAIN_13121 | *Macaca fascicularis* | 832 | 3.353 | 3.98E−04 |
| DOMAIN_13125 | *Macaca fascicularis* | 833 | 3.2101 | 3.31E−04 |
| DOMAIN_13171 | *Phascolarctos cinereus* | 834 | 3.0052 | 0.0061932 |
| DOMAIN_13193 | *Sapajus apella* | 835 | 3.8948 | 1.53E−07 |
| DOMAIN_13227 | *Oryctolagus cuniculus* | 836 | 2.3234 | 0.0034855 |
| DOMAIN_13269 | *Desmodus rotundus* | 837 | 2.7236 | 0.0010081 |
| DOMAIN_13277 | *Macaca fascicularis* | 838 | 2.9151 | 4.66E−04 |
| DOMAIN_13282 | *Phascolarctos cinereus* | 839 | 3.5504 | 8.75E−04 |
| DOMAIN_13284 | *Phascolarctos cinereus* | 840 | 3.0903 | 0.0057642 |
| DOMAIN_13293 | *Myotis lucifugus* | 841 | 2.5884 | 6.56E−04 |
| DOMAIN_13325 | *Macaca fascicularis* | 842 | 2.4051 | 0.0085787 |
| DOMAIN_13332 | *Phascolarctos cinereus* | 843 | 2.685 | 0.0052498 |
| DOMAIN_13333 | *Phascolarctos cinereus* | 844 | 2.9787 | 0.0079948 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_13339 | *Puma concolor* | 845 | 3.2731 | 5.64E−04 |
| DOMAIN_13346 | *Oryctolagus cuniculus* | 846 | 2.9551 | 0.0031649 |
| DOMAIN_13363 | *Phyllostomus discolor* | 847 | 2.2178 | 0.0041619 |
| DOMAIN_13364 | *Macaca fascicularis* | 848 | 3.5606 | 2.40E−05 |
| DOMAIN_13379 | *Phascolarctos cinereus* | 849 | 3.2967 | 0.0018734 |
| DOMAIN_13380 | *Myotis lucifugus* | 850 | 3.6615 | 1.09E−05 |
| DOMAIN_13387 | *Sapajus apella* | 851 | 2.8731 | 0.001777 |
| DOMAIN_13417 | *Ailuropoda melanoleuca* | 852 | 3.7056 | 1.17E−04 |
| DOMAIN_13439 | *Sapajus apella* | 853 | 2.5091 | 0.0050786 |
| DOMAIN_13470 | *Phascolarctos cinereus* | 854 | 3.7598 | 2.40E−05 |
| DOMAIN_13486 | *Puma concolor* | 855 | 3.4895 | 7.93E−04 |
| DOMAIN_13501 | *Macaca fascicularis* | 856 | 2.8162 | 0.0083892 |
| DOMAIN_13509 | *Phascolarctos cinereus* | 857 | 2.8053 | 0.00351 |
| DOMAIN_13516 | *Phascolarctos cinereus* | 858 | 2.4421 | 0.0034809 |
| DOMAIN_13536 | Gorilla | 859 | 3.3269 | 0.0064418 |
| DOMAIN_13537 | *Ailuropoda melanoleuca* | 860 | 3.3265 | 8.83E−05 |
| DOMAIN_13562 | *Phascolarctos cinereus* | 861 | 3.7608 | 4.71E−04 |
| DOMAIN_13565 | *Phascolarctos cinereus* | 862 | 2.994 | 0.0032926 |
| DOMAIN_13574 | *Puma concolor* | 863 | 3.1114 | 6.89E−04 |
| DOMAIN_13591 | *Lynx canadensis* | 864 | 3.215 | 5.12E−04 |
| DOMAIN_13601 | *Macaca fascicularis* | 865 | 2.4865 | 0.0065955 |
| DOMAIN_13609 | *Phascolarctos cinereus* | 866 | 3.1787 | 0.002393 |
| DOMAIN_13610 | *Phascolarctos cinereus* | 867 | 3.1925 | 0.0018707 |
| DOMAIN_13644 | *Phascolarctos cinereus* | 868 | 3.2677 | 0.001927 |
| DOMAIN_13648 | *Oryctolagus cuniculus* | 869 | 3.1393 | 0.0014022 |
| DOMAIN_13650 | *Ailuropoda melanoleuca* | 870 | 3.8556 | 4.44E−06 |
| DOMAIN_13664 | *Macaca fascicularis* | 871 | 2.7443 | 0.002582 |
| DOMAIN_13670 | *Phascolarctos cinereus* | 872 | 3.154 | 4.21E−04 |
| DOMAIN_13690 | *Sapajus apella* | 873 | 3.2587 | 0.0017001 |
| DOMAIN_13691 | *Sapajus apella* | 874 | 2.6205 | 0.0033052 |
| DOMAIN_13703 | *Lynx canadensis* | 875 | 3.7947 | 2.43E−05 |
| DOMAIN_13705 | *Phyllostomus discolor* | 876 | 2.496 | 0.009207 |
| DOMAIN_13722 | *Phascolarctos cinereus* | 877 | 2.4814 | 0.0058557 |
| DOMAIN_13723 | *Phascolarctos cinereus* | 878 | 2.9677 | 0.0026349 |
| DOMAIN_13733 | *Sapajus apella* | 879 | 3.3285 | 1.82E−04 |
| DOMAIN_13783 | *Macaca fascicularis* | 880 | 2.5821 | 0.0093056 |
| DOMAIN_13805 | *Lynx canadensis* | 881 | 3.1769 | 0.0088613 |
| DOMAIN_13823 | *Macaca fascicularis* | 882 | 4.219 | 1.53E−07 |
| DOMAIN_13830 | *Phascolarctos cinereus* | 883 | 2.6435 | 0.0033465 |
| DOMAIN_13832 | *Phascolarctos cinereus* | 884 | 2.9705 | 0.0077505 |
| DOMAIN_13843 | *Phascolarctos cinereus* | 885 | 3.6119 | 1.81E−04 |
| DOMAIN_13851 | *Canis lupus familiaris* | 886 | 2.6472 | 0.0033845 |
| DOMAIN_13859 | *Macaca fascicularis* | 887 | 2.2006 | 0.0086366 |
| DOMAIN_13878 | *Ailuropoda melanoleuca* | 888 | 4.3232 | 4.75E−06 |
| DOMAIN_13880 | *Lynx canadensis* | 889 | 3.0991 | 0.0013743 |
| DOMAIN_13907 | *Phascolarctos cinereus* | 890 | 2.4263 | 0.0084749 |
| DOMAIN_13910 | *Bos mutus* | 891 | 2.9556 | 0.0048664 |
| DOMAIN_13915 | *Muntiacus muntjak* | 892 | 2.8554 | 0.0080147 |
| DOMAIN_13958 | *Phascolarctos cinereus* | 893 | 3.2926 | 9.78E−05 |
| DOMAIN_13970 | *Lynx canadensis* | 894 | 2.89 | 0.0058701 |
| DOMAIN_13979 | *Macaca fascicularis* | 895 | 2.6188 | 0.0016793 |
| DOMAIN_13981 | *Phascolarctos cinereus* | 896 | 2.8041 | 0.0024451 |
| DOMAIN_13984 | *Phascolarctos cinereus* | 897 | 2.8513 | 0.0029797 |
| DOMAIN_13987 | *Myotis lucifugus* | 898 | 3.0633 | 4.59E−04 |
| DOMAIN_13997 | *Puma concolor* | 899 | 2.984 | 2.51E−04 |
| DOMAIN_14009 | *Ailuropoda melanoleuca* | 900 | 2.9207 | 5.05E−05 |
| DOMAIN_14013 | *Ailuropoda melanoleuca* | 901 | 2.4619 | 0.0082352 |
| DOMAIN_14031 | *Phyllostomus discolor* | 902 | 3.0963 | 0.0045422 |
| DOMAIN_14040 | *Phascolarctos cinereus* | 903 | 3.0933 | 0.0065673 |
| DOMAIN_14041 | *Phascolarctos cinereus* | 904 | 2.9069 | 0.0077333 |
| DOMAIN_14049 | *Phascolarctos cinereus* | 905 | 2.7761 | 0.0052936 |
| DOMAIN_14069 | *Lynx canadensis* | 906 | 2.9182 | 0.0020008 |
| DOMAIN_14082 | *Phyllostomus discolor* | 907 | 3.2495 | 2.19E−04 |
| DOMAIN_14083 | *Phyllostomus discolor* | 908 | 2.7465 | 0.0042213 |
| DOMAIN_14108 | *Canis lupus familiaris* | 909 | 3.0621 | 0.004127 |
| DOMAIN_14129 | *Lynx canadensis* | 910 | 2.8195 | 0.0026925 |
| DOMAIN_14135 | *Bos mutus* | 911 | 2.426 | 0.0033513 |
| DOMAIN_14147 | *Canis lupus familiaris* | 912 | 3.3683 | 2.59E−04 |
| DOMAIN_14153 | *Muntiacus muntjak* | 913 | 2.883 | 0.0011637 |
| DOMAIN_14197 | *Muntiacus muntjak* | 914 | 2.9589 | 0.0041555 |
| DOMAIN_14219 | *Ailuropoda melanoleuca* | 915 | 2.6653 | 0.0035657 |
| DOMAIN_14226 | *Lynx canadensis* | 916 | 3.1176 | 0.0020645 |
| DOMAIN_14228 | *Lynx canadensis* | 917 | 3.3445 | 7.54E−04 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_14256 | *Lynx canadensis* | 918 | 2.4946 | 0.0066852 |
| DOMAIN_14287 | *Bos indicus* | 919 | 3.6232 | 1.66E−04 |
| DOMAIN_14295 | *Muntiacus muntjak* | 920 | 3.4018 | 7.22E−04 |
| DOMAIN_14322 | *Desmodus rotundus* | 921 | 3.3716 | 1.94E−04 |
| DOMAIN_14337 | *Muntiacus muntjak* | 922 | 3.2753 | 2.86E−05 |
| DOMAIN_14338 | *Ailuropoda melanoleuca* | 923 | 3.1071 | 0.0022421 |
| DOMAIN_14358 | *Lynx canadensis* | 924 | 2.7094 | 8.85E−04 |
| DOMAIN_14365 | *Desmodus rotundus* | 925 | 3.0706 | 1.39E−04 |
| DOMAIN_14373 | *Macaca fascicularis* | 926 | 2.5861 | 0.0069375 |
| DOMAIN_14382 | *Phascolarctos cinereus* | 927 | 4.0523 | 7.52E−05 |
| DOMAIN_14444 | *Phyllostomus discolor* | 928 | 2.4641 | 0.0037357 |
| DOMAIN_14487 | *Ailuropoda melanoleuca* | 929 | 2.7981 | 0.0050538 |
| DOMAIN_14526 | *Ailuropoda melanoleuca* | 930 | 3.2232 | 0.003818 |
| DOMAIN_14532 | *Lynx canadensis* | 931 | 3.2071 | 2.43E−04 |
| DOMAIN_14534 | *Lynx canadensis* | 932 | 2.8122 | 0.0039834 |
| DOMAIN_14546 | *Muntiacus muntjak* | 933 | 3.5039 | 5.01E−05 |
| DOMAIN_14551 | *Ailuropoda melanoleuca* | 934 | 3.6894 | 2.30E−06 |
| DOMAIN_14557 | *Lynx canadensis* | 935 | 2.9876 | 2.85E−04 |
| DOMAIN_14574 | Gorilla | 936 | 3.3356 | 7.83E−04 |
| DOMAIN_14576 | *Ailuropoda melanoleuca* | 937 | 3.2158 | 0.0028459 |
| DOMAIN_14602 | Gorilla | 938 | 3.2145 | 0.0037718 |
| DOMAIN_14627 | *Acinonyx jubatus* | 939 | 2.9501 | 0.0033732 |
| DOMAIN_14639 | Rhesus | 940 | 2.7046 | 0.0033915 |
| DOMAIN_14714 | *Odocoileus virginianus texanus* | 941 | 3.2752 | 2.48E−04 |
| DOMAIN_14746 | *Odocoileus virginianus texanus* | 942 | 2.605 | 0.0084645 |
| DOMAIN_14773 | *Sapajus apella* | 943 | 3.5997 | 1.45E−05 |
| DOMAIN_14794 | *Acinonyx jubatus* | 944 | 3.4295 | 4.09E−04 |
| DOMAIN_14795 | *Rhinopithecus roxellana* | 945 | 2.8119 | 0.0024062 |
| DOMAIN_14800 | *Rhinopithecus roxellana* | 946 | 2.274 | 0.0012494 |
| DOMAIN_14815 | *Cebus imitator* | 947 | 3.3826 | 0.0075808 |
| DOMAIN_14820 | *Callithrix jacchus* | 948 | 2.8836 | 0.0021743 |
| DOMAIN_14829 | *Rhinopithecus roxellana* | 949 | 2.7188 | 4.08E−04 |
| DOMAIN_14845 | *Cebus imitator* | 950 | 2.7224 | 0.0041993 |
| DOMAIN_14849 | *Cebus imitator* | 951 | 2.3659 | 0.0093133 |
| DOMAIN_14862 | *Callithrix jacchus* | 952 | 2.8116 | 0.0079314 |
| DOMAIN_14864 | Rhesus | 953 | 3.3492 | 2.46E−04 |
| DOMAIN_14885 | *Cebus imitator* | 954 | 3.5373 | 4.09E−05 |
| DOMAIN_14901 | *Bos taurus* | 955 | 2.9774 | 0.0085175 |
| DOMAIN_14905 | *Rhinopithecus roxellana* | 956 | 3.372 | 0.0034794 |
| DOMAIN_14928 | *Callithrix jacchus* | 957 | 3.1547 | 2.58E−04 |
| DOMAIN_14939 | *Callorhinus ursinus* | 958 | 2.3884 | 0.0071338 |
| DOMAIN_14946 | *Acinonyx jubatus* | 959 | 3.2842 | 7.46E−04 |
| DOMAIN_14948 | *Acinonyx jubatus* | 960 | 3.3727 | 1.73E−04 |
| DOMAIN_14974 | *Sapajus apella* | 961 | 2.9963 | 0.0091608 |
| DOMAIN_14977 | *Sapajus apella* | 962 | 3.0085 | 5.11E−04 |
| DOMAIN_14978 | *Acinonyx jubatus* | 963 | 3.0358 | 0.0017363 |
| DOMAIN_14983 | *Rhinopithecus roxellana* | 964 | 3.704 | 1.53E−07 |
| DOMAIN_14994 | *Bison bison bison* | 965 | 2.4997 | 0.0054874 |
| DOMAIN_14995 | *Cebus imitator* | 966 | 3.5057 | 4.13E−06 |
| DOMAIN_15042 | *Ovis aries* | 967 | 3.0774 | 0.0045881 |
| DOMAIN_15070 | *Callithrix jacchus* | 968 | 4.0108 | 2.60E−04 |
| DOMAIN_15083 | *Ovis aries* | 969 | 2.7541 | 7.89E−04 |
| DOMAIN_15086 | *Ovis aries* | 970 | 3.5994 | 2.56E−04 |
| DOMAIN_15089 | *Vulpes vulpes* | 971 | 2.3585 | 0.0076298 |
| DOMAIN_15102 | *Acinonyx jubatus* | 972 | 3.0929 | 0.0033921 |
| DOMAIN_15103 | *Bison bison bison* | 973 | 2.652 | 0.0021839 |
| DOMAIN_15119 | *Callithrix jacchus* | 974 | 3.3838 | 2.60E−06 |
| DOMAIN_15137 | *Ovis aries* | 975 | 2.7071 | 0.0022528 |
| DOMAIN_15138 | *Vulpes vulpes* | 976 | 3.1771 | 6.85E−04 |
| DOMAIN_15159 | *Ovis aries* | 977 | 3.2135 | 0.0012084 |
| DOMAIN_15171 | *Vulpes vulpes* | 978 | 3.2837 | 2.40E−05 |
| DOMAIN_15174 | *Vulpes vulpes* | 979 | 3.1387 | 0.0033116 |
| DOMAIN_15184 | *Acinonyx jubatus* | 980 | 3.0092 | 0.0021588 |
| DOMAIN_15197 | *Acinonyx jubatus* | 981 | 3.0957 | 0.0012736 |
| DOMAIN_15227 | *Rhinopithecus roxellana* | 982 | 3.5532 | 4.75E−06 |
| DOMAIN_15233 | *Rhinopithecus roxellana* | 983 | 2.788 | 0.0046622 |
| DOMAIN_15234 | *Acinonyx jubatus* | 984 | 3.546 | 0.0019916 |
| DOMAIN_15241 | *Odocoileus virginianus texanus* | 985 | 3.3955 | 3.85E−04 |
| DOMAIN_15251 | *Callithrix jacchus* | 986 | 2.2209 | 9.47E−04 |
| DOMAIN_15254 | *Callithrix jacchus* | 987 | 3.5159 | 2.32E−04 |
| DOMAIN_15267 | *Ovis aries* | 988 | 2.8528 | 0.0020149 |
| DOMAIN_15269 | *Ovis aries* | 989 | 2.0839 | 0.0057336 |
| DOMAIN_15278 | *Callithrix jacchus* | 990 | 3.2523 | 0.0089241 |

TABLE 54-continued

List of 1,597 repressor domain candidates identified from the high-throughput screen assessing dXR repression of the HBEGF gene and subsequent application of the following criteria: p-value <0.01 and $\log_2$(fold change) >2

| Domain ID | Species | SEQ ID NO | Log2 (fold change) | P-value |
|---|---|---|---|---|
| DOMAIN_15279 | *Callithrix jacchus* | 991 | 3.8574 | 6.87E−05 |
| DOMAIN_15352 | *Cebus imitator* | 992 | 3.0832 | 0.0079363 |
| DOMAIN_15354 | *Tursiops truncatus* | 993 | 3.5099 | 5.16E−05 |
| DOMAIN_15356 | *Acinonyx jubatus* | 994 | 3.5466 | 0.0019099 |
| DOMAIN_15360 | *Neophocaena asiaeorientalis asiaeorientalis* | 995 | 3.2575 | 3.95E−04 |
| DOMAIN_15363 | Orangutan | 996 | 4.3121 | 1.53E−07 |
| DOMAIN_15391 | *Leptonychotes weddellii* | 997 | 3.9053 | 1.53E−07 |
| DOMAIN_15406 | Chimp | 998 | 3.4616 | 1.53E−07 |
| DOMAIN_15419 | *Rhinopithecus roxellana* | 999 | 2.6943 | 0.0012439 |
| DOMAIN_15426 | *Odocoileus virginianus texanus* | 1000 | 2.9673 | 0.0024959 |
| DOMAIN_15447 | *Rhinopithecus roxellana* | 1001 | 3.1112 | 0.0031907 |
| DOMAIN_15451 | *Bison bison bison* | 1002 | 3.2905 | 0.0024601 |
| DOMAIN_15527 | *Balaenoptera acutorostrata scammoni* | 1003 | 3.0354 | 0.0023685 |
| DOMAIN_15536 | *Cebus imitator* | 1004 | 2.4515 | 0.0048713 |
| DOMAIN_15540 | *Callithrix jacchus* | 1005 | 3.124 | 0.0020464 |
| DOMAIN_15575 | *Callithrix jacchus* | 1006 | 2.594 | 0.0095671 |
| DOMAIN_15577 | *Callithrix jacchus* | 1007 | 2.4456 | 0.0010642 |
| DOMAIN_15581 | *Callorhinus ursinus* | 1008 | 3.2465 | 0.0031873 |
| DOMAIN_15586 | *Callorhinus ursinus* | 1009 | 2.6157 | 0.002815 |
| DOMAIN_15603 | *Cebus imitator* | 1010 | 3.5111 | 0.0027084 |
| DOMAIN_15605 | *Cebus imitator* | 1011 | 3.8196 | 2.50E−04 |
| DOMAIN_15634 | *Delphinapterus leucas* | 1012 | 3.3574 | 0.0025587 |
| DOMAIN_15636 | Chimp | 1013 | 2.2086 | 0.0062339 |
| DOMAIN_15638 | *Sapajus apella* | 1014 | 3.4277 | 1.53E−07 |
| DOMAIN_15669 | *Callorhinus ursinus* | 1015 | 2.8865 | 0.0027889 |
| DOMAIN_15687 | *Cebus imitator* | 1016 | 2.5362 | 0.0063187 |
| DOMAIN_15688 | *Cebus imitator* | 1017 | 3.2098 | 6.98E−04 |
| DOMAIN_15693 | Rhesus | 1018 | 3.8571 | 9.95E−06 |
| DOMAIN_15699 | *Bos taurus* | 1019 | 3.5255 | 7.09E−04 |
| DOMAIN_15753 | *Ovis aries* | 1020 | 3.1699 | 0.0035272 |
| DOMAIN_15759 | *Ovis aries* | 1021 | 3.1884 | 0.0011061 |
| DOMAIN_15764 | *Otolemur garnettii* | 1022 | 3.107 | 3.97E−04 |
| DOMAIN_15800 | *Otolemur garnettii* | 1023 | 3.4462 | 1.80E−04 |
| DOMAIN_15814 | Rhesus | 1024 | 3.9503 | 3.26E−05 |
| DOMAIN_15823 | *Ovis aries* | 1025 | 2.8458 | 0.0034405 |
| DOMAIN_15834 | *Otolemur garnettii* | 1026 | 3.7629 | 1.30E−05 |
| DOMAIN_15839 | *Callithrix jacchus* | 1027 | 2.3399 | 0.0090833 |
| DOMAIN_15863 | *Vulpes vulpes* | 1028 | 2.7434 | 0.0042734 |
| DOMAIN_15931 | *Ovis aries* | 1029 | 3.0861 | 0.0028731 |
| DOMAIN_15940 | *Enhydra lutris kenyoni* | 1030 | 2.8684 | 0.007571 |
| DOMAIN_15956 | *Bos taurus* | 1031 | 3.2271 | 4.36E−04 |
| DOMAIN_15972 | *Enhydra lutris kenyoni* | 1032 | 2.3299 | 1.05E−04 |
| DOMAIN_16009 | *Zalophus californianus* | 1033 | 3.2738 | 0.0020718 |
| DOMAIN_16011 | *Delphinapterus leucas* | 1034 | 4.3363 | 1.53E−07 |
| DOMAIN_16017 | *Ovis aries* | 1035 | 2.6715 | 0.0041604 |
| DOMAIN_16023 | *Rhinopithecus bieti* | 1036 | 2.2831 | 0.0064672 |
| DOMAIN_16050 | *Ovis aries* | 1037 | 2.7105 | 0.0086883 |
| DOMAIN_16063 | Rhesus | 1038 | 2.1603 | 0.0054023 |
| DOMAIN_16084 | *Enhydra lutris kenyoni* | 1039 | 3.0131 | 0.0022672 |
| DOMAIN_16115 | *Bos taurus* | 1040 | 2.9023 | 0.0027605 |
| DOMAIN_16123 | *Ovis aries* | 1041 | 2.3799 | 0.0079176 |
| DOMAIN_16147 | Orangutan | 1042 | 2.5699 | 4.83E−04 |
| DOMAIN_16184 | *Ovis aries* | 1043 | 3.7743 | 4.44E−06 |
| DOMAIN_16188 | *Otolemur garnettii* | 1044 | 2.5145 | 0.0014414 |
| DOMAIN_16238 | Orangutan | 1045 | 3.8734 | 2.87E−04 |
| DOMAIN_16246 | Rhesus | 1046 | 2.3971 | 3.89E−04 |
| DOMAIN_16253 | *Ovis aries* | 1047 | 4.488 | 1.53E−07 |
| DOMAIN_16266 | *Otolemur garnettii* | 1048 | 3.075 | 0.0019834 |
| DOMAIN_16274 | *Otolemur garnettii* | 1049 | 2.7655 | 0.0014904 |
| DOMAIN_16312 | *Vicugna pacos* | 1050 | 2.4302 | 0.0024702 |
| DOMAIN_16323 | *Trichechus manatus latirostris* | 1051 | 4.0053 | 2.15E−04 |
| DOMAIN_16340 | *Ovis aries* | 1052 | 2.778 | 0.0034068 |
| DOMAIN_16372 | *Odocoileus virginianus texanus* | 1053 | 4.2664 | 1.53E−07 |
| DOMAIN_16378 | *Callithrix jacchus* | 1054 | 2.9868 | 0.0037718 |
| DOMAIN_16399 | *Rhinopithecus roxellana* | 1055 | 4.0639 | 1.53E−07 |
| DOMAIN_16408 | *Cebus imitator* | 1056 | 2.0194 | 0.009233 |
| DOMAIN_16461 | *Cebus imitator* | 1057 | 3.1155 | 0.0020676 |
| DOMAIN_16471 | *Acinonyx jubatus* | 1058 | 3.3465 | 0.0021006 |
| DOMAIN_16478 | *Rhinopithecus roxellana* | 1059 | 2.8285 | 0.0023275 |
| DOMAIN_16516 | Rhesus | 1060 | 3.8473 | 1.94E−05 |
| DOMAIN_16517 | *Callithrix jacchus* | 1061 | 3.3189 | 2.60E−06 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_16534 | *Acinonyx jubatus* | 1062 | 2.7531 | 0.0057425 |
| DOMAIN_16556 | *Rhinopithecus roxellana* | 1063 | 2.4217 | 0.0084734 |
| DOMAIN_16566 | *Odocoileus virginianus texanus* | 1064 | 3.3903 | 7.82E−04 |
| DOMAIN_16576 | Chimp | 1065 | 2.6949 | 0.0021998 |
| DOMAIN_16597 | *Cebus imitator* | 1066 | 2.9869 | 0.0023416 |
| DOMAIN_16611 | *Papio anubis* | 1067 | 3.4786 | 1.53E−07 |
| DOMAIN_16618 | *Ursus maritimus* | 1068 | 3.1184 | 0.0015351 |
| DOMAIN_16629 | *Cebus imitator* | 1069 | 3.7569 | 1.57E−04 |
| DOMAIN_16630 | *Cebus imitator* | 1070 | 3.2435 | 1.36E−04 |
| DOMAIN_16638 | *Macaca nemestrina* | 1071 | 3.3871 | 0.0011337 |
| DOMAIN_16648 | *Physeter macrocephalus* | 1072 | 3.629 | 1.88E−05 |
| DOMAIN_16651 | *Delphinapterus leucas* | 1073 | 2.0926 | 0.0074143 |
| DOMAIN_16659 | *Leptonychotes weddellii* | 1074 | 3.8913 | 2.37E−05 |
| DOMAIN_16664 | *Leptonychotes weddellii* | 1075 | 3.4502 | 1.76E−05 |
| DOMAIN_16673 | *Phascolarctos cinereus* | 1076 | 3.0938 | 0.0039727 |
| DOMAIN_16677 | Orangutan | 1077 | 3.1577 | 0.0023254 |
| DOMAIN_16694 | *Callorhinus ursinus* | 1078 | 2.0979 | 0.0094743 |
| DOMAIN_16695 | *Callorhinus ursinus* | 1079 | 3.965 | 3.06E−07 |
| DOMAIN_16696 | *Tursiops truncatus* | 1080 | 3.0806 | 0.002705 |
| DOMAIN_16703 | *Phascolarctos cinereus* | 1081 | 3.3969 | 2.19E−04 |
| DOMAIN_16731 | *Ursus arctos horribilis* | 1082 | 2.849 | 1.30E−05 |
| DOMAIN_16734 | *Leptonychotes weddellii* | 1083 | 3.4791 | 2.57E−04 |
| DOMAIN_16738 | Chimp | 1084 | 3.5957 | 8.11E−06 |
| DOMAIN_16744 | *Enhydra lutris kenyoni* | 1085 | 3.637 | 6.38E−05 |
| DOMAIN_16763 | *Monodelphis domestica* | 1086 | 2.9244 | 0.0053031 |
| DOMAIN_16771 | *Saimiri boliviensis boliviensis* | 1087 | 3.3025 | 0.0027295 |
| DOMAIN_16773 | *Balaenoptera acutorostrata scammoni* | 1088 | 4.5309 | 1.38E−06 |
| DOMAIN_16776 | *Callorhinus ursinus* | 1089 | 3.0877 | 0.0024757 |
| DOMAIN_16809 | *Delphinapterus leucas* | 1090 | 2.4357 | 0.0068567 |
| DOMAIN_16811 | *Balaenoptera acutorostrata scammoni* | 1091 | 3.5141 | 3.08E−04 |
| DOMAIN_16856 | *Ursus maritimus* | 1092 | 2.7613 | 0.0040844 |
| DOMAIN_16865 | *Papio anubis* | 1093 | 3.9619 | 1.53E−07 |
| DOMAIN_16876 | *Callorhinus ursinus* | 1094 | 3.2183 | 4.66E−04 |
| DOMAIN_16877 | *Rhinolophus ferrumequinum* | 1095 | 3.3745 | 3.78E−05 |
| DOMAIN_16936 | *Rhinopithecus roxellana* | 1096 | 2.9808 | 0.0044295 |
| DOMAIN_16953 | *Callorhinus ursinus* | 1097 | 3.3286 | 1.62E−04 |
| DOMAIN_16973 | *Delphinapterus leucas* | 1098 | 3.0187 | 0.0041062 |
| DOMAIN_16994 | *Odocoileus virginianus texanus* | 1099 | 3.0575 | 0.0025431 |
| DOMAIN_17001 | *Rhinolophus ferrumequinum* | 1100 | 3.045 | 0.003661 |
| DOMAIN_17023 | *Sapajus apella* | 1101 | 2.5472 | 0.0041588 |
| DOMAIN_17027 | *Balaenoptera acutorostrata scammoni* | 1102 | 3.131 | 0.0028042 |
| DOMAIN_17041 | *Rhinopithecus roxellana* | 1103 | 2.7589 | 0.0074146 |
| DOMAIN_17062 | *Rhinopithecus roxellana* | 1104 | 3.2594 | 7.33E−05 |
| DOMAIN_17105 | Rhesus | 1105 | 2.637 | 0.0054256 |
| DOMAIN_17108 | *Phyllostomus discolor* | 1106 | 2.4499 | 0.0018315 |
| DOMAIN_17134 | *Panthera pardus* | 1107 | 3.2502 | 0.0016926 |
| DOMAIN_17139 | *Ursus arctos horribilis* | 1108 | 4.0326 | 2.13E−05 |
| DOMAIN_17153 | *Ursus arctos horribilis* | 1109 | 2.1759 | 0.0043459 |
| DOMAIN_17167 | *Ursus maritimus* | 1110 | 4.1644 | 1.52E−05 |
| DOMAIN_17177 | *Physeter macrocephalus* | 1111 | 3.2446 | 0.002928 |
| DOMAIN_17180 | *Zalophus californianus* | 1112 | 2.945 | 0.0082198 |
| DOMAIN_17195 | *Ursus maritimus* | 1113 | 3.0566 | 0.0037464 |
| DOMAIN_17202 | *Ursus arctos horribilis* | 1114 | 2.6589 | 0.0072284 |
| DOMAIN_17206 | *Pteropus vampyrus* | 1115 | 3.7092 | 5.05E−06 |
| DOMAIN_17234 | *Delphinapterus leucas* | 1116 | 2.0152 | 0.0059669 |
| DOMAIN_17236 | *Rhinolophus ferrumequinum* | 1117 | 2.7166 | 0.0039056 |
| DOMAIN_17241 | *Muntiacus muntjak* | 1118 | 2.2217 | 0.003544 |
| DOMAIN_17264 | *Vicugna pacos* | 1119 | 3.0866 | 0.0021294 |
| DOMAIN_17278 | *Tursiops truncatus* | 1120 | 3.4898 | 4.12E−05 |
| DOMAIN_17279 | *Bison bison bison* | 1121 | 3.591 | 8.11E−06 |
| DOMAIN_17333 | *Camelus dromedarius* | 1122 | 2.8765 | 0.003642 |
| DOMAIN_17340 | *Leptonychotes weddellii* | 1123 | 3.1536 | 5.34E−05 |
| DOMAIN_17382 | *Leptonychotes weddellii* | 1124 | 3.075 | 0.0035284 |
| DOMAIN_17383 | *Leptonychotes weddellii* | 1125 | 2.953 | 0.0032519 |
| DOMAIN_17412 | *Ovis aries* | 1126 | 4.9319 | 1.53E−07 |
| DOMAIN_17421 | *Vulpes vulpes* | 1127 | 3.3129 | 2.83E−05 |
| DOMAIN_17474 | *Monodelphis domestica* | 1128 | 2.683 | 0.0036059 |
| DOMAIN_17483 | *Cercocebus atys* | 1129 | 3.5742 | 3.44E−05 |
| DOMAIN_17495 | *Neomonachus schauinslandi* | 1130 | 3.1828 | 5.59E−05 |
| DOMAIN_17497 | *Monodelphis domestica* | 1131 | 2.8088 | 5.07E−05 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_17509 | *Physeter macrocephalus* | 1132 | 3.438 | 8.07E−04 |
| DOMAIN_17516 | *Monodelphis domestica* | 1133 | 3.1523 | 4.18E−04 |
| DOMAIN_17525 | *Myotis davidii* | 1134 | 3.4986 | 7.28E−04 |
| DOMAIN_17534 | *Cercocebus atys* | 1135 | 2.9374 | 0.0033612 |
| DOMAIN_17547 | *Neomonachus schauinslandi* | 1136 | 3.2455 | 5.64E−04 |
| DOMAIN_17548 | *Neomonachus schauinslandi* | 1137 | 2.8002 | 5.08E−04 |
| DOMAIN_17574 | *Cercocebus atys* | 1138 | 3.4893 | 2.80E−05 |
| DOMAIN_17632 | *Monodelphis domestica* | 1139 | 3.3689 | 2.06E−04 |
| DOMAIN_17658 | *Monodelphis domestica* | 1140 | 3.8781 | 1.99E−06 |
| DOMAIN_17662 | *Monodelphis domestica* | 1141 | 2.7612 | 0.0040459 |
| DOMAIN_17666 | *Monodelphis domestica* | 1142 | 2.6895 | 0.002059 |
| DOMAIN_17671 | *Monodelphis domestica* | 1143 | 3.0937 | 0.008519 |
| DOMAIN_17689 | *Cercocebus atys* | 1144 | 3.6469 | 1.53E−07 |
| DOMAIN_17704 | *Neomonachus schauinslandi* | 1145 | 3.1047 | 0.0028404 |
| DOMAIN_17714 | *Monodelphis domestica* | 1146 | 2.2724 | 0.0043612 |
| DOMAIN_17717 | *Physeter macrocephalus* | 1147 | 2.9442 | 7.54E−04 |
| DOMAIN_17748 | *Leptonychotes weddellii* | 1148 | 3.0918 | 2.44E−04 |
| DOMAIN_17752 | *Leptonychotes weddellii* | 1149 | 3.2541 | 4.59E−04 |
| DOMAIN_17775 | *Camelus dromedarius* | 1150 | 2.6595 | 0.0033885 |
| DOMAIN_17798 | Orangutan | 1151 | 3.3458 | 5.16E−05 |
| DOMAIN_17801 | Orangutan | 1152 | 2.9733 | 0.0022819 |
| DOMAIN_17871 | *Leptonychotes weddellii* | 1153 | 3.1894 | 1.49E−05 |
| DOMAIN_17873 | *Leptonychotes weddellii* | 1154 | 3.4076 | 3.00E−04 |
| DOMAIN_17890 | *Cercocebus atys* | 1155 | 4.2356 | 2.80E−05 |
| DOMAIN_17898 | *Enhydra lutris kenyoni* | 1156 | 3.2117 | 0.0034476 |
| DOMAIN_17903 | Orangutan | 1157 | 2.4683 | 0.0030976 |
| DOMAIN_17925 | *Otolemur garnettii* | 1158 | 2.7982 | 0.0042639 |
| DOMAIN_18048 | OwlMonkey | 1159 | 2.5186 | 0.0087422 |
| DOMAIN_18083 | *Papio anubis* | 1160 | 2.9283 | 4.79E−04 |
| DOMAIN_18100 | *Neomonachus schauinslandi* | 1161 | 2.3606 | 0.0061598 |
| DOMAIN_18103 | *Monodelphis domestica* | 1162 | 2.7334 | 0.0056181 |
| DOMAIN_18136 | *Monodelphis domestica* | 1163 | 2.7288 | 6.75E−04 |
| DOMAIN_18155 | *Sarcophilus harrisii* | 1164 | 2.7528 | 0.0052222 |
| DOMAIN_18161 | *Cercocebus atys* | 1165 | 2.6663 | 0.0060803 |
| DOMAIN_18181 | *Physeter macrocephalus* | 1166 | 4.696 | 4.59E−07 |
| DOMAIN_18203 | *Monodelphis domestica* | 1167 | 3.7912 | 4.81E−04 |
| DOMAIN_18206 | *Monodelphis domestica* | 1168 | 2.3929 | 0.0046062 |
| DOMAIN_18214 | *Physeter macrocephalus* | 1169 | 2.6389 | 0.0094737 |
| DOMAIN_18227 | OwlMonkey | 1170 | 3.5267 | 5.66E−06 |
| DOMAIN_18241 | *Leptonychotes weddellii* | 1171 | 3.8187 | 9.60E−05 |
| DOMAIN_18243 | *Felis catus* | 1172 | 3.5331 | 6.96E−04 |
| DOMAIN_18244 | *Leptonychotes weddellii* | 1173 | 3.1726 | 0.0050817 |
| DOMAIN_18272 | *Neomonachus schauinslandi* | 1174 | 2.9141 | 0.0085916 |
| DOMAIN_18303 | *Monodelphis domestica* | 1175 | 2.9174 | 0.0018489 |
| DOMAIN_18312 | *Monodelphis domestica* | 1176 | 2.8473 | 8.20E−04 |
| DOMAIN_18323 | *Monodelphis domestica* | 1177 | 2.3956 | 0.0040336 |
| DOMAIN_18325 | *Monodelphis domestica* | 1178 | 2.7636 | 0.0038297 |
| DOMAIN_18332 | *Monodelphis domestica* | 1179 | 3.4328 | 4.68E−04 |
| DOMAIN_18345 | *Monodelphis domestica* | 1180 | 3.349 | 4.43E−04 |
| DOMAIN_18356 | *Monodelphis domestica* | 1181 | 3.1967 | 4.67E−04 |
| DOMAIN_18385 | *Neomonachus schauinslandi* | 1182 | 2.1472 | 0.0044932 |
| DOMAIN_18415 | *Neomonachus schauinslandi* | 1183 | 2.9768 | 4.55E−04 |
| DOMAIN_18424 | *Physeter macrocephalus* | 1184 | 3.7744 | 3.31E−04 |
| DOMAIN_18426 | *Physeter macrocephalus* | 1185 | 2.8011 | 0.0079672 |
| DOMAIN_18428 | *Physeter macrocephalus* | 1186 | 2.5903 | 0.0095383 |
| DOMAIN_18433 | OwlMonkey | 1187 | 3.4614 | 0.0022427 |
| DOMAIN_18441 | *Felis catus* | 1188 | 3.7534 | 1.77E−04 |
| DOMAIN_18458 | *Monodelphis domestica* | 1189 | 3.1061 | 0.0018603 |
| DOMAIN_18459 | *Monodelphis domestica* | 1190 | 3.1352 | 2.38E−04 |
| DOMAIN_18483 | *Monodelphis domestica* | 1191 | 2.8259 | 5.19E−04 |
| DOMAIN_18485 | *Monodelphis domestica* | 1192 | 2.8817 | 0.0011922 |
| DOMAIN_18498 | OwlMonkey | 1193 | 2.7354 | 0.0021141 |
| DOMAIN_18502 | *Myotis davidii* | 1194 | 3.4127 | 1.93E−04 |
| DOMAIN_18504 | *Cercocebus atys* | 1195 | 3.2213 | 5.38E−04 |
| DOMAIN_18536 | *Camelus dromedarius* | 1196 | 3.2028 | 0.0011217 |
| DOMAIN_18580 | *Cercocebus atys* | 1197 | 4.4477 | 3.22E−06 |
| DOMAIN_18589 | *Neomonachus schauinslandi* | 1198 | 3.039 | 0.0025063 |
| DOMAIN_18594 | *Monodelphis domestica* | 1199 | 3.2119 | 0.0036607 |
| DOMAIN_18618 | *Physeter macrocephalus* | 1200 | 2.6489 | 0.0072165 |
| DOMAIN_18646 | *Monodelphis domestica* | 1201 | 2.4678 | 0.007646 |
| DOMAIN_18670 | *Neomonachus schauinslandi* | 1202 | 3.1792 | 3.80E−04 |
| DOMAIN_18677 | *Monodelphis domestica* | 1203 | 2.2686 | 0.0068996 |
| DOMAIN_18693 | *Camelus dromedarius* | 1204 | 3.0179 | 0.0013759 |

TABLE 54-continued

List of 1,597 repressor domain candidates identified from the high-throughput screen assessing dXR repression of the HBEGF gene and subsequent application of the following criteria: p-value <0.01 and $\log_2$(fold change) >2

| Domain ID | Species | SEQ ID NO | Log2 (fold change) | P-value |
|---|---|---|---|---|
| DOMAIN_18698 | *Felis catus* | 1205 | 3.3067 | 0.0093304 |
| DOMAIN_18711 | *Vulpes vulpes* | 1206 | 2.2749 | 0.0063986 |
| DOMAIN_18724 | Chimp | 1207 | 3.2062 | 5.16E−04 |
| DOMAIN_18726 | *Myotis davidii* | 1208 | 2.9362 | 0.0025771 |
| DOMAIN_18734 | *Monodelphis domestica* | 1209 | 2.8813 | 0.0092612 |
| DOMAIN_18752 | *Monodelphis domestica* | 1210 | 3.5544 | 4.85E−05 |
| DOMAIN_18753 | *Monodelphis domestica* | 1211 | 2.6101 | 3.54E−04 |
| DOMAIN_18760 | Chimp | 1212 | 3.1806 | 7.49E−05 |
| DOMAIN_18785 | *Leptonychotes weddellii* | 1213 | 2.9139 | 0.0019203 |
| DOMAIN_18817 | *Monodelphis domestica* | 1214 | 2.2496 | 0.0091589 |
| DOMAIN_18830 | *Monodelphis domestica* | 1215 | 3.2719 | 0.0032764 |
| DOMAIN_18835 | *Camelus dromedarius* | 1216 | 2.4878 | 8.56E−05 |
| DOMAIN_18873 | *Camelus dromedarius* | 1217 | 3.262 | 0.0049846 |
| DOMAIN_18891 | Orangutan | 1218 | 3.6429 | 1.38E−06 |
| DOMAIN_18923 | *Callithrix jacchus* | 1219 | 2.2053 | 0.0054504 |
| DOMAIN_18935 | *Ovis aries* | 1220 | 3.4507 | 3.14E−05 |
| DOMAIN_18947 | *Enhydra lutris kenyoni* | 1221 | 3.3167 | 7.58E−04 |
| DOMAIN_18971 | *Enhydra lutris kenyoni* | 1222 | 3.3941 | 5.05E−06 |
| DOMAIN_18977 | Orangutan | 1223 | 3.6262 | 9.03E−06 |
| DOMAIN_18979 | Orangutan | 1224 | 2.0034 | 0.0071822 |
| DOMAIN_19005 | *Enhydra lutris kenyoni* | 1225 | 3.4092 | 4.57E−04 |
| DOMAIN_19028 | Orangutan | 1226 | 2.3618 | 0.0022277 |
| DOMAIN_19056 | *Bos indicus* × *Bos taurus* | 1227 | 3.0542 | 0.001874 |
| DOMAIN_19072 | *Vulpes vulpes* | 1228 | 2.8133 | 0.0016331 |
| DOMAIN_19079 | *Otolemur garnettii* | 1229 | 4.0159 | 4.88E−05 |
| DOMAIN_19125 | *Otolemur garnettii* | 1230 | 2.9892 | 8.36E−04 |
| DOMAIN_19207 | *Enhydra lutris kenyoni* | 1231 | 2.655 | 0.0091617 |
| DOMAIN_19220 | *Camelus dromedarius* | 1232 | 3.1947 | 0.0088687 |
| DOMAIN_19221 | *Camelus dromedarius* | 1233 | 3.1733 | 4.21E−04 |
| DOMAIN_19299 | *Myotis davidii* | 1234 | 2.8882 | 0.0043533 |
| DOMAIN_19351 | Orangutan | 1235 | 3.1988 | 2.17E−04 |
| DOMAIN_19385 | *Monodelphis domestica* | 1236 | 2.9198 | 0.008105 |
| DOMAIN_19387 | *Monodelphis domestica* | 1237 | 3.4706 | 1.85E−04 |
| DOMAIN_19388 | *Physeter macrocephalus* | 1238 | 3.2831 | 7.71E−04 |
| DOMAIN_19404 | *Monodelphis domestica* | 1239 | 2.0125 | 0.0031965 |
| DOMAIN_19423 | *Monodelphis domestica* | 1240 | 3.49 | 0.002544 |
| DOMAIN_19424 | *Monodelphis domestica* | 1241 | 2.5838 | 0.0041846 |
| DOMAIN_19437 | OwlMonkey | 1242 | 2.826 | 0.001773 |
| DOMAIN_19445 | *Monodelphis domestica* | 1243 | 2.1105 | 0.0078325 |
| DOMAIN_19447 | *Monodelphis domestica* | 1244 | 3.4492 | 1.40E−04 |
| DOMAIN_19487 | *Monodelphis domestica* | 1245 | 3.4312 | 6.00E−04 |
| DOMAIN_19497 | *Monodelphis domestica* | 1246 | 3.466 | 2.80E−05 |
| DOMAIN_19517 | *Monodelphis domestica* | 1247 | 3.3361 | 1.04E−04 |
| DOMAIN_19533 | *Papio anubis* | 1248 | 2.5831 | 4.67E−04 |
| DOMAIN_19563 | *Papio anubis* | 1249 | 2.5522 | 0.0089134 |
| DOMAIN_19580 | *Monodelphis domestica* | 1250 | 3.5716 | 3.29E−05 |
| DOMAIN_19585 | *Monodelphis domestica* | 1251 | 3.0031 | 0.0032403 |
| DOMAIN_19596 | *Monodelphis domestica* | 1252 | 3.8583 | 8.18E−05 |
| DOMAIN_19597 | *Monodelphis domestica* | 1253 | 3.5081 | 4.46E−04 |
| DOMAIN_19600 | *Monodelphis domestica* | 1254 | 2.5854 | 0.0042185 |
| DOMAIN_19602 | *Physeter macrocephalus* | 1255 | 2.7219 | 0.0058524 |
| DOMAIN_19611 | *Lipotes vexillifer* | 1256 | 3.3901 | 4.24E−04 |
| DOMAIN_19629 | *Monodelphis domestica* | 1257 | 3.0535 | 0.0017954 |
| DOMAIN_19699 | *Otolemur garnettii* | 1258 | 2.8474 | 3.15E−04 |
| DOMAIN_19708 | *Bos indicus* × *Bos taurus* | 1259 | 3.6339 | 8.02E−04 |
| DOMAIN_19713 | Chimp | 1260 | 3.845 | 2.95E−05 |
| DOMAIN_19721 | *Otolemur garnettii* | 1261 | 2.6913 | 0.0089069 |
| DOMAIN_19776 | *Enhydra lutris kenyoni* | 1262 | 2.617 | 0.0093497 |
| DOMAIN_19777 | Orangutan | 1263 | 3.2427 | 0.0075444 |
| DOMAIN_19780 | Orangutan | 1264 | 3.0867 | 1.72E−04 |
| DOMAIN_19786 | Chimp | 1265 | 2.9155 | 5.94E−04 |
| DOMAIN_19788 | *Enhydra lutris kenyoni* | 1266 | 3.3393 | 4.71E−04 |
| DOMAIN_19800 | *Zalophus californianus* | 1267 | 2.368 | 0.009162 |
| DOMAIN_19805 | *Rhinolophus ferrumequinum* | 1268 | 2.6527 | 0.0030997 |
| DOMAIN_19818 | *Rhinopithecus roxellana* | 1269 | 2.3477 | 0.0022161 |
| DOMAIN_19883 | *Zalophus californianus* | 1270 | 3.5504 | 3.42E−04 |
| DOMAIN_19886 | *Panthera pardus* | 1271 | 2.8642 | 4.04E−05 |
| DOMAIN_19889 | *Vicugna pacos* | 1272 | 3.1963 | 4.15E−05 |
| DOMAIN_19891 | *Zalophus californianus* | 1273 | 3.2135 | 0.0010023 |
| DOMAIN_19921 | *Callorhinus ursinus* | 1274 | 2.0083 | 0.0055679 |
| DOMAIN_19944 | *Zalophus californianus* | 1275 | 3.8559 | 8.71E−05 |
| DOMAIN_19947 | Bonobo | 1276 | 2.2608 | 0.00818 |
| DOMAIN_19967 | *Tursiops truncatus* | 1277 | 2.9548 | 0.0027997 |

TABLE 54-continued

List of 1,597 repressor domain candidates identified from the high-throughput screen assessing dXR repression of the HBEGF gene and subsequent application of the following criteria: p-value <0.01 and $\log_2$(fold change) >2

| Domain ID | Species | SEQ ID NO | Log2 (fold change) | P-value |
|---|---|---|---|---|
| DOMAIN_19968 | *Tursiops truncatus* | 1278 | 2.8089 | 0.004093 |
| DOMAIN_19990 | *Panthera pardus* | 1279 | 3.5329 | 0.0018768 |
| DOMAIN_19993 | *Tursiops truncatus* | 1280 | 3.4227 | 0.0047476 |
| DOMAIN_20012 | *Leptonychotes weddellii* | 1281 | 3.8253 | 3.41E−05 |
| DOMAIN_20023 | *Physeter macrocephalus* | 1282 | 3.6893 | 5.78E−04 |
| DOMAIN_20025 | *Carlito syrichta* | 1283 | 2.2451 | 0.002157 |
| DOMAIN_20030 | *Tursiops truncatus* | 1284 | 4.1273 | 3.22E−06 |
| DOMAIN_20089 | *Panthera pardus* | 1285 | 4.2275 | 8.99E−05 |
| DOMAIN_20095 | *Phascolarctos cinereus* | 1286 | 3.7141 | 1.55E−05 |
| DOMAIN_20115 | *Physeter macrocephalus* | 1287 | 3.1154 | 0.0030089 |
| DOMAIN_20134 | *Acinonyx jubatus* | 1288 | 3.2457 | 3.20E−04 |
| DOMAIN_20136 | *Sus scrofa* | 1289 | 3.3856 | 2.94E−04 |
| DOMAIN_20147 | *Odocoileus virginianus texanus* | 1290 | 3.7467 | 1.53E−07 |
| DOMAIN_20171 | *Trichechus manatus latirostris* | 1291 | 3.951 | 1.03E−05 |
| DOMAIN_20208 | *Pteropus vampyrus* | 1292 | 2.4805 | 0.0041634 |
| DOMAIN_20249 | *Vicugna pacos* | 1293 | 2.7041 | 0.0043741 |
| DOMAIN_20250 | *Phascolarctos cinereus* | 1294 | 3.5525 | 1.37E−04 |
| DOMAIN_20287 | *Cercocebus atys* | 1295 | 3.4486 | 5.29E−04 |
| DOMAIN_20318 | *Callithrix jacchus* | 1296 | 3.5311 | 3.52E−06 |
| DOMAIN_20332 | *Callithrix jacchus* | 1297 | 3.2855 | 0.0011689 |
| DOMAIN_20336 | *Panthera pardus* | 1298 | 2.3293 | 0.0076785 |
| DOMAIN_20345 | *Cebus imitator* | 1299 | 3.8132 | 1.53E−07 |
| DOMAIN_20352 | *Vicugna pacos* | 1300 | 2.9839 | 9.79E−04 |
| DOMAIN_20359 | *Pteropus vampyrus* | 1301 | 3.9594 | 4.06E−05 |
| DOMAIN_20371 | *Ursus arctos horribilis* | 1302 | 2.8418 | 0.0061393 |
| DOMAIN_20381 | *Saimiri boliviensis boliviensis* | 1303 | 2.0412 | 0.0013486 |
| DOMAIN_20398 | *Physeter macrocephalus* | 1304 | 3.1266 | 0.0039215 |
| DOMAIN_20436 | *Sus scrofa* | 1305 | 2.724 | 0.0058616 |
| DOMAIN_20455 | *Nomascus leucogenys* | 1306 | 3.112 | 2.94E−04 |
| DOMAIN_20462 | *Trichechus manatus latirostris* | 1307 | 5.4429 | 1.53E−07 |
| DOMAIN_20469 | *Equus caballus* | 1308 | 2.7506 | 0.0077201 |
| DOMAIN_20487 | *Mandrillus leucophaeus* | 1309 | 2.8325 | 0.0020982 |
| DOMAIN_20524 | *Nomascus leucogenys* | 1310 | 3.2893 | 0.0024993 |
| DOMAIN_20537 | *Chlorocebus sabaeus* | 1311 | 3.2762 | 0.0027249 |
| DOMAIN_20540 | *Mandrillus leucophaeus* | 1312 | 2.8477 | 0.0021931 |
| DOMAIN_20545 | *Sus scrofa* | 1313 | 2.711 | 0.0086718 |
| DOMAIN_20561 | *Chrysochloris asiatica* | 1314 | 3.8309 | 3.52E−05 |
| DOMAIN_20565 | *Suricata suricatta* | 1315 | 3.148 | 2.90E−04 |
| DOMAIN_20601 | *Sus scrofa* | 1316 | 2.9097 | 0.0037911 |
| DOMAIN_20652 | *Neophocaena asiaeorientalis asiaeorientalis* | 1317 | 2.7283 | 0.0038931 |
| DOMAIN_20667 | *Suricata suricatta* | 1318 | 3.7485 | 1.38E−06 |
| DOMAIN_20674 | *Mandrillus leucophaeus* | 1319 | 3.3115 | 1.53E−07 |
| DOMAIN_20716 | *Suricata suricatta* | 1320 | 3.6174 | 3.02E−05 |
| DOMAIN_20729 | *Mandrillus leucophaeus* | 1321 | 2.5535 | 0.0090894 |
| DOMAIN_20746 | *Chrysochloris asiatica* | 1322 | 3.4727 | 4.79E−04 |
| DOMAIN_20767 | *Sus scrofa* | 1323 | 3.1224 | 3.16E−04 |
| DOMAIN_20835 | *Suricata suricatta* | 1324 | 3.0025 | 0.0031432 |
| DOMAIN_20915 | *Mandrillus leucophaeus* | 1325 | 2.4373 | 0.0054586 |
| DOMAIN_20998 | Bonobo | 1326 | 2.6659 | 0.0044767 |
| DOMAIN_21010 | *Equus caballus* | 1327 | 2.2253 | 0.0040982 |
| DOMAIN_21023 | *Sarcophilus harrisii* | 1328 | 3.1196 | 0.0023342 |
| DOMAIN_21067 | *Zalophus californianus* | 1329 | 3.0246 | 0.0010917 |
| DOMAIN_21082 | *Loxodonta africana* | 1330 | 3.2032 | 0.0040056 |
| DOMAIN_21086 | *Pteropus vampyrus* | 1331 | 2.1339 | 0.0079029 |
| DOMAIN_21095 | *Trichechus manatus latirostris* | 1332 | 2.5003 | 0.0091721 |
| DOMAIN_21110 | *Neovison vison* | 1333 | 2.499 | 0.0065113 |
| DOMAIN_21123 | *Callorhinus ursinus* | 1334 | 3.237 | 4.13E−04 |
| DOMAIN_21133 | *Suricata suricatta* | 1335 | 3.1021 | 4.18E−04 |
| DOMAIN_21161 | *Sarcophilus harrisii* | 1336 | 3.2208 | 5.87E−04 |
| DOMAIN_21162 | *Sarcophilus harrisii* | 1337 | 2.885 | 6.85E−04 |
| DOMAIN_21175 | *Callorhinus ursinus* | 1338 | 3.3334 | 2.29E−04 |
| DOMAIN_21197 | *Tursiops truncatus* | 1339 | 2.214 | 0.0073288 |
| DOMAIN_21226 | *Sarcophilus harrisii* | 1340 | 2.6942 | 0.0033484 |
| DOMAIN_21260 | *Pteropus vampyrus* | 1341 | 3.1806 | 0.0039855 |
| DOMAIN_21276 | *Mandrillus leucophaeus* | 1342 | 3.0178 | 0.0029699 |
| DOMAIN_21277 | OwlMonkey | 1343 | 2.7115 | 0.0075352 |
| DOMAIN_21312 | *Lipotes vexillifer* | 1344 | 3.5287 | 4.75E−06 |
| DOMAIN_21333 | *Zalophus californianus* | 1345 | 3.5801 | 3.57E−05 |
| DOMAIN_21334 | *Equus caballus* | 1346 | 2.9508 | 8.67E−04 |
| DOMAIN_21335 | *Equus caballus* | 1347 | 2.518 | 0.0034809 |
| DOMAIN_21367 | *Equus caballus* | 1348 | 2.9921 | 0.0091001 |
| DOMAIN_21369 | *Equus caballus* | 1349 | 2.7947 | 0.0011824 |

TABLE 54-continued

List of 1,597 repressor domain candidates identified from the high-throughput screen assessing dXR repression of the HBEGF gene and subsequent application of the following criteria: p-value <0.01 and $\log_2$(fold change) >2

| Domain ID | Species | SEQ ID NO | Log2 (fold change) | P-value |
|---|---|---|---|---|
| DOMAIN_21371 | *Physeter macrocephalus* | 1350 | 3.8804 | 4.44E−06 |
| DOMAIN_21421 | *Pteropus vampyrus* | 1351 | 2.7713 | 7.52E−05 |
| DOMAIN_21481 | Bonobo | 1352 | 2.7056 | 0.0012415 |
| DOMAIN_21494 | *Tursiops truncatus* | 1353 | 3.783 | 1.36E−04 |
| DOMAIN_21583 | *Sarcophilus harrisii* | 1354 | 3.1529 | 0.0026931 |
| DOMAIN_21588 | *Callorhinus ursinus* | 1355 | 3.4914 | 5.39E−04 |
| DOMAIN_21612 | OwlMonkey | 1356 | 3.2931 | 4.09E−05 |
| DOMAIN_21626 | *Monodelphis domestica* | 1357 | 3.5419 | 1.57E−04 |
| DOMAIN_21632 | *Monodelphis domestica* | 1358 | 2.6551 | 0.0071923 |
| DOMAIN_21658 | *Monodelphis domestica* | 1359 | 3.1325 | 2.50E−04 |
| DOMAIN_21786 | *Trichechus manatus latirostris* | 1360 | 3.2249 | 2.76E−04 |
| DOMAIN_21822 | *Equus caballus* | 1361 | 3.5647 | 3.22E−06 |
| DOMAIN_21823 | *Equus caballus* | 1362 | 3.2474 | 0.0072446 |
| DOMAIN_21844 | OwlMonkey | 1363 | 3.467 | 4.44E−06 |
| DOMAIN_21862 | *Chlorocebus sabaeus* | 1364 | 2.3797 | 0.0032299 |
| DOMAIN_21889 | *Equus caballus* | 1365 | 3.6563 | 4.18E−04 |
| DOMAIN_21896 | *Lipotes vexillifer* | 1366 | 2.8718 | 0.0093653 |
| DOMAIN_21900 | *Equus caballus* | 1367 | 2.7606 | 0.0041711 |
| DOMAIN_21909 | *Suricata suricatta* | 1368 | 3.2301 | 3.40E−04 |
| DOMAIN_21928 | *Callorhinus ursinus* | 1369 | 3.758 | 1.67E−05 |
| DOMAIN_21947 | *Trichechus manatus latirostris* | 1370 | 3.1204 | 0.003623 |
| DOMAIN_21951 | *Equus caballus* | 1371 | 2.8972 | 3.24E−04 |
| DOMAIN_21985 | *Suricata suricatta* | 1372 | 3.6273 | 1.99E−06 |
| DOMAIN_21988 | *Sarcophilus harrisii* | 1373 | 3.3393 | 0.0011817 |
| DOMAIN_21993 | *Lipotes vexillifer* | 1374 | 2.5494 | 0.0039206 |
| DOMAIN_22022 | *Tursiops truncatus* | 1375 | 3.9558 | 4.44E−06 |
| DOMAIN_22079 | *Trichechus manatus latirostris* | 1376 | 3.4511 | 6.43E−04 |
| DOMAIN_22117 | *Sarcophilus harrisii* | 1377 | 2.5969 | 0.0040801 |
| DOMAIN_22143 | *Pteropus vampyrus* | 1378 | 2.6595 | 9.36E−04 |
| DOMAIN_22151 | *Trichechus manatus latirostris* | 1379 | 3.1615 | 5.26E−04 |
| DOMAIN_22158 | *Lipotes vexillifer* | 1380 | 2.0562 | 0.0010562 |
| DOMAIN_22166 | *Trichechus manatus latirostris* | 1381 | 4.2024 | 2.53E−05 |
| DOMAIN_22192 | *Trichechus manatus latirostris* | 1382 | 2.8134 | 0.0083622 |
| DOMAIN_22220 | Bonobo | 1383 | 2.8922 | 0.0013379 |
| DOMAIN_22268 | *Lipotes vexillifer* | 1384 | 2.6534 | 0.0053876 |
| DOMAIN_22278 | *Pteropus vampyrus* | 1385 | 3.3575 | 0.0037798 |
| DOMAIN_22280 | *Pteropus vampyrus* | 1386 | 3.1521 | 0.0017347 |
| DOMAIN_22285 | *Trichechus manatus latirostris* | 1387 | 3.0261 | 6.83E−04 |
| DOMAIN_22297 | *Sarcophilus harrisii* | 1388 | 2.4261 | 0.0066953 |
| DOMAIN_22311 | *Monodelphis domestica* | 1389 | 2.9903 | 0.0017115 |
| DOMAIN_22322 | *Tursiops truncatus* | 1390 | 3.4452 | 3.85E−04 |
| DOMAIN_22366 | OwlMonkey | 1391 | 4.848 | 3.06E−07 |
| DOMAIN_22375 | *Tursiops truncatus* | 1392 | 2.5484 | 0.0090894 |
| DOMAIN_22381 | *Tursiops truncatus* | 1393 | 3.8641 | 2.63E−04 |
| DOMAIN_22383 | *Pteropus vampyrus* | 1394 | 3.4752 | 2.48E−04 |
| DOMAIN_22407 | OwlMonkey | 1395 | 2.5308 | 0.0081831 |
| DOMAIN_22425 | OwlMonkey | 1396 | 3.0333 | 0.0032208 |
| DOMAIN_22430 | *Callorhinus ursinus* | 1397 | 2.982 | 0.0064761 |
| DOMAIN_22454 | *Monodelphis domestica* | 1398 | 2.6042 | 0.0022491 |
| DOMAIN_22458 | *Monodelphis domestica* | 1399 | 3.0003 | 0.0025373 |
| DOMAIN_22459 | *Monodelphis domestica* | 1400 | 2.9261 | 0.0013171 |
| DOMAIN_22462 | *Monodelphis domestica* | 1401 | 3.5597 | 2.34E−05 |
| DOMAIN_22471 | *Papio anubis* | 1402 | 3.6293 | 1.68E−06 |
| DOMAIN_22479 | OwlMonkey | 1403 | 3.9668 | 4.18E−05 |
| DOMAIN_22483 | OwlMonkey | 1404 | 2.1702 | 0.0013107 |
| DOMAIN_22495 | *Callorhinus ursinus* | 1405 | 2.2623 | 0.0043918 |
| DOMAIN_22512 | OwlMonkey | 1406 | 2.93 | 0.003255 |
| DOMAIN_22518 | *Lipotes vexillifer* | 1407 | 2.8869 | 0.0024472 |
| DOMAIN_22520 | *Callorhinus ursinus* | 1408 | 3.3586 | 2.83E−05 |
| DOMAIN_22527 | *Tursiops truncatus* | 1409 | 2.989 | 9.71E−04 |
| DOMAIN_22566 | *Papio anubis* | 1410 | 3.5278 | 6.63E−05 |
| DOMAIN_22586 | *Nomascus leucogenys* | 1411 | 2.1811 | 0.0021723 |
| DOMAIN_22615 | *Homo sapiens* | 1412 | 3.0957 | 4.43E−04 |
| DOMAIN_22654 | *Ursus arctos horribilis* | 1413 | 3.248 | 5.59E−05 |
| DOMAIN_22667 | *Saimiri boliviensis boliviensis* | 1414 | 3.4947 | 0.0037256 |
| DOMAIN_22669 | *Balaenoptera acutorostrata scammoni* | 1415 | 3.583 | 4.34E−04 |
| DOMAIN_22692 | *Propithecus coquereli* | 1416 | 3.2791 | 3.52E−04 |
| DOMAIN_22710 | *Propithecus coquereli* | 1417 | 3.4387 | 0.0032081 |
| DOMAIN_22740 | *Panthera pardus* | 1418 | 2.692 | 0.0027611 |
| DOMAIN_22742 | *Panthera pardus* | 1419 | 2.9133 | 0.0027938 |
| DOMAIN_22768 | *Ursus maritimus* | 1420 | 4.0609 | 7.81E−06 |
| DOMAIN_22771 | *Ursus americanus* | 1421 | 3.3498 | 2.83E−05 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_22776 | *Propithecus coquereli* | 1422 | 2.7757 | 2.88E−04 |
| DOMAIN_22778 | *Saimiri boliviensis boliviensis* | 1423 | 3.1251 | 4.93E−04 |
| DOMAIN_22782 | *Vombatus ursinus* | 1424 | 3.1663 | 4.24E−04 |
| DOMAIN_22917 | *Cervus elaphus hippelaphus* | 1425 | 3.8061 | 2.77E−05 |
| DOMAIN_22919 | *Colobus angolensis palliatus* | 1426 | 2.8609 | 0.003796 |
| DOMAIN_22928 | *Tupaia chinensis* | 1427 | 3.0141 | 0.0015348 |
| DOMAIN_22937 | *Ursus arctos horribilis* | 1428 | 3.0779 | 0.0032951 |
| DOMAIN_22939 | *Muntiacus reevesi* | 1429 | 3.6187 | 1.78E−04 |
| DOMAIN_22944 | *Muntiacus reevesi* | 1430 | 3.3908 | 5.28E−04 |
| DOMAIN_23007 | *Lynx pardinus* | 1431 | 3.7329 | 1.09E−04 |
| DOMAIN_23009 | *Saimiri boliviensis boliviensis* | 1432 | 3.1269 | 0.0062706 |
| DOMAIN_23011 | *Cervus elaphus hippelaphus* | 1433 | 3.6236 | 3.51E−05 |
| DOMAIN_23012 | *Cervus elaphus hippelaphus* | 1434 | 3.6131 | 2.50E−04 |
| DOMAIN_23013 | *Cervus elaphus hippelaphus* | 1435 | 3.4615 | 4.85E−04 |
| DOMAIN_23018 | *Colobus angolensis palliatus* | 1436 | 3.4177 | 2.30E−04 |
| DOMAIN_23039 | *Saimiri boliviensis boliviensis* | 1437 | 2.8829 | 5.70E−04 |
| DOMAIN_23040 | *Saimiri boliviensis boliviensis* | 1438 | 2.5742 | 0.0056531 |
| DOMAIN_23041 | *Vombatus ursinus* | 1439 | 3.6194 | 1.92E−04 |
| DOMAIN_23050 | *Balaenoptera acutorostrata scammoni* | 1440 | 2.9754 | 0.003318 |
| DOMAIN_23082 | *Mustela putorius furo* | 1441 | 3.9481 | 5.17E−05 |
| DOMAIN_23093 | *Propithecus coquereli* | 1442 | 3.2165 | 5.48E−04 |
| DOMAIN_23109 | *Mustela putorius furo* | 1443 | 2.9639 | 0.0019589 |
| DOMAIN_23113 | *Camelus ferus* | 1444 | 3.4612 | 3.52E−04 |
| DOMAIN_23136 | *Vicugna pacos* | 1445 | 3.285 | 2.16E−04 |
| DOMAIN_23181 | *Colobus angolensis palliatus* | 1446 | 2.7665 | 0.0021609 |
| DOMAIN_23196 | *Odobenus rosmarus divergens* | 1447 | 4.3363 | 3.22E−06 |
| DOMAIN_23200 | *Ursus americanus* | 1448 | 3.755 | 1.84E−06 |
| DOMAIN_23215 | *Vombatus ursinus* | 1449 | 3.0212 | 0.0035725 |
| DOMAIN_23217 | *Vombatus ursinus* | 1450 | 4.1674 | 2.76E−06 |
| DOMAIN_23239 | *Vicugna pacos* | 1451 | 3.0945 | 0.0090937 |
| DOMAIN_23250 | *Delphinapterus leucas* | 1452 | 2.71 | 3.14E−04 |
| DOMAIN_23260 | *Tupaia chinensis* | 1453 | 2.7567 | 0.0029622 |
| DOMAIN_23281 | *Colobus angolensis palliatus* | 1454 | 2.5048 | 0.0036625 |
| DOMAIN_23286 | *Mustela putorius furo* | 1455 | 3.3651 | 1.66E−04 |
| DOMAIN_23301 | *Gulo gulo* | 1456 | 2.6839 | 0.0035226 |
| DOMAIN_23323 | *Erinaceus europaeus* | 1457 | 3.2619 | 0.0031362 |
| DOMAIN_23331 | *Carlito syrichta* | 1458 | 2.8995 | 5.23E−04 |
| DOMAIN_23336 | *Carlito syrichta* | 1459 | 2.239 | 0.0065533 |
| DOMAIN_23341 | *Carlito syrichta* | 1460 | 2.656 | 0.0058992 |
| DOMAIN_23375 | *Vicugna pacos* | 1461 | 3.266 | 7.64E−04 |
| DOMAIN_23378 | *Odobenus rosmarus divergens* | 1462 | 3.0623 | 0.0016508 |
| DOMAIN_23419 | *Gulo gulo* | 1463 | 3.5213 | 7.41E−04 |
| DOMAIN_23453 | *Carlito syrichta* | 1464 | 2.2331 | 0.006161 |
| DOMAIN_23454 | *Carlito syrichta* | 1465 | 3.0632 | 7.96E−04 |
| DOMAIN_23458 | *Vicugna pacos* | 1466 | 2.4232 | 0.0045857 |
| DOMAIN_23480 | *Odobenus rosmarus divergens* | 1467 | 3.4432 | 3.38E−04 |
| DOMAIN_23494 | *Mustela putorius furo* | 1468 | 3.847 | 5.05E−06 |
| DOMAIN_23508 | *Mustela putorius furo* | 1469 | 2.3582 | 0.0047712 |
| DOMAIN_23513 | *Tupaia chinensis* | 1470 | 3.2927 | 5.31E−05 |
| DOMAIN_23514 | *Odobenus rosmarus divergens* | 1471 | 3.0166 | 4.77E−04 |
| DOMAIN_23561 | *Colobus angolensis palliatus* | 1472 | 3.2392 | 0.0021906 |
| DOMAIN_23574 | *Gulo gulo* | 1473 | 2.939 | 0.0083249 |
| DOMAIN_23575 | *Erinaceus europaeus* | 1474 | 3.4624 | 0.001589 |
| DOMAIN_23576 | *Erinaceus europaeus* | 1475 | 3.8014 | 2.89E−05 |
| DOMAIN_23590 | *Odobenus rosmarus divergens* | 1476 | 2.8653 | 0.0052881 |
| DOMAIN_23604 | *Vicugna pacos* | 1477 | 2.6984 | 0.0046123 |
| DOMAIN_23641 | *Carlito syrichta* | 1478 | 2.6942 | 0.0081075 |
| DOMAIN_23642 | *Delphinapterus leucas* | 1479 | 3.8829 | 2.28E−04 |
| DOMAIN_23654 | *Carlito syrichta* | 1480 | 2.337 | 0.0083622 |
| DOMAIN_23679 | *Tupaia chinensis* | 1481 | 3.7951 | 5.10E−05 |
| DOMAIN_23680 | *Vicugna pacos* | 1482 | 2.712 | 0.0034785 |
| DOMAIN_23709 | *Carlito syrichta* | 1483 | 4.545 | 1.53E−07 |
| DOMAIN_23711 | *Gulo gulo* | 1484 | 2.658 | 0.0016432 |
| DOMAIN_23721 | *Carlito syrichta* | 1485 | 2.972 | 0.0022972 |
| DOMAIN_23731 | *Colobus angolensis palliatus* | 1486 | 3.1609 | 2.35E−04 |
| DOMAIN_23745 | *Myotis brandtii* | 1487 | 3.4544 | 3.54E−04 |
| DOMAIN_23793 | *Odobenus rosmarus divergens* | 1488 | 2.7573 | 0.0081197 |
| DOMAIN_23804 | *Colobus angolensis palliatus* | 1489 | 2.3403 | 0.0086366 |
| DOMAIN_23827 | *Odobenus rosmarus divergens* | 1490 | 2.3013 | 0.009767 |
| DOMAIN_23854 | *Gulo gulo* | 1491 | 3.838 | 7.18E−05 |
| DOMAIN_23856 | *Erinaceus europaeus* | 1492 | 3.1072 | 0.0035694 |
| DOMAIN_23863 | *Mustela putorius furo* | 1493 | 2.8758 | 0.0085493 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_23885 | *Colobus angolensis palliatus* | 1494 | 3.033 | 0.0034316 |
| DOMAIN_23895 | *Mustela putorius furo* | 1495 | 2.6148 | 0.003318 |
| DOMAIN_23898 | *Mustela putorius furo* | 1496 | 2.7383 | 0.0035921 |
| DOMAIN_23916 | *Odobenus rosmarus divergens* | 1497 | 3.3232 | 1.63E−04 |
| DOMAIN_23931 | *Gulo gulo* | 1498 | 3.8077 | 1.49E−05 |
| DOMAIN_23940 | *Homo sapiens* | 1499 | 2.5087 | 0.0010424 |
| DOMAIN_23953 | *Muntiacus reevesi* | 1500 | 2.4156 | 0.0075055 |
| DOMAIN_23979 | *Balaenoptera acutorostrata scammoni* | 1501 | 4.0461 | 5.77E−05 |
| DOMAIN_24020 | *Rhinolophus ferrumequinum* | 1502 | 3.1125 | 1.66E−04 |
| DOMAIN_24028 | *Ursus arctos horribilis* | 1503 | 3.8797 | 1.53E−07 |
| DOMAIN_24035 | *Propithecus coquereli* | 1504 | 3.2225 | 0.0017975 |
| DOMAIN_24042 | *Propithecus coquereli* | 1505 | 3.3038 | 4.75E−06 |
| DOMAIN_24083 | *Myotis brandtii* | 1506 | 3.9804 | 2.77E−05 |
| DOMAIN_24113 | *Propithecus coquereli* | 1507 | 3.3264 | 2.89E−04 |
| DOMAIN_24152 | *Vombatus ursinus* | 1508 | 3.3664 | 0.0022672 |
| DOMAIN_24204 | *Propithecus coquereli* | 1509 | 3.0779 | 4.60E−04 |
| DOMAIN_24212 | *Pteropus alecto* | 1510 | 2.498 | 0.0034998 |
| DOMAIN_24230 | *Muntiacus reevesi* | 1511 | 3.1832 | 1.53E−07 |
| DOMAIN_24256 | *Ursus arctos horribilis* | 1512 | 2.7933 | 0.0018808 |
| DOMAIN_24282 | *Muntiacus reevesi* | 1513 | 2.694 | 0.0052575 |
| DOMAIN_24306 | *Propithecus coquereli* | 1514 | 3.2084 | 0.0023952 |
| DOMAIN_24317 | *Myotis brandtii* | 1515 | 3.9767 | 3.17E−05 |
| DOMAIN_24379 | *Macaca nemestrina* | 1516 | 2.4643 | 0.0086804 |
| DOMAIN_24393 | *Propithecus coquereli* | 1517 | 3.8008 | 2.45E−06 |
| DOMAIN_24446 | *Propithecus coquereli* | 1518 | 3.6312 | 7.27E−05 |
| DOMAIN_24463 | *Balaenoptera acutorostrata scammoni* | 1519 | 2.5362 | 0.007147 |
| DOMAIN_24496 | *Ursus americanus* | 1520 | 3.6403 | 4.24E−04 |
| DOMAIN_24515 | *Balaenoptera acutorostrata scammoni* | 1521 | 3.7358 | 5.28E−05 |
| DOMAIN_24518 | *Balaenoptera acutorostrata scammoni* | 1522 | 3.4135 | 3.05E−05 |
| DOMAIN_24546 | *Ursus americanus* | 1523 | 3.4262 | 8.42E−06 |
| DOMAIN_24570 | *Saimiri boliviensis boliviensis* | 1524 | 3.6773 | 1.45E−05 |
| DOMAIN_24571 | *Balaenoptera acutorostrata scammoni* | 1525 | 2.6912 | 0.0038376 |
| DOMAIN_24600 | *Ursus americanus* | 1526 | 3.156 | 0.0012483 |
| DOMAIN_24614 | *Cervus elaphus hippelaphus* | 1527 | 2.6295 | 0.0046463 |
| DOMAIN_24615 | *Colobus angolensis palliatus* | 1528 | 2.4075 | 0.0069247 |
| DOMAIN_24653 | *Cervus elaphus hippelaphus* | 1529 | 2.9883 | 0.0083016 |
| DOMAIN_24677 | *Lynx pardinus* | 1530 | 2.3115 | 0.0094713 |
| DOMAIN_24719 | *Muntiacus reevesi* | 1531 | 2.7499 | 0.005142 |
| DOMAIN_24725 | *Ursus arctos horribilis* | 1532 | 3.4496 | 4.09E−05 |
| DOMAIN_24771 | *Myotis brandtii* | 1533 | 3.3701 | 0.0025351 |
| DOMAIN_24786 | *Vombatus ursinus* | 1534 | 2.9237 | 0.0078001 |
| DOMAIN_24788 | *Vombatus ursinus* | 1535 | 2.7694 | 0.0021557 |
| DOMAIN_24838 | *Pteropus alecto* | 1536 | 2.3323 | 0.0042954 |
| DOMAIN_24867 | *Nomascus leucogenys* | 1537 | 3.469 | 2.97E−04 |
| DOMAIN_24903 | *Ailuropoda melanoleuca* | 1538 | 3.0377 | 0.0030054 |
| DOMAIN_24939 | *Phascolarctos cinereus* | 1539 | 3.3066 | 6.08E−04 |
| DOMAIN_24947 | *Ursus maritimus* | 1540 | 2.9491 | 0.0055208 |
| DOMAIN_24975 | *Muntiacus muntjak* | 1541 | 3.2737 | 0.0069767 |
| DOMAIN_24993 | *Oryctolagus cuniculus* | 1542 | 3.3817 | 5.00E−04 |
| DOMAIN_25016 | *Oryctolagus cuniculus* | 1543 | 2.9822 | 0.0034776 |
| DOMAIN_25052 | *Pteropus alecto* | 1544 | 2.3634 | 0.0072024 |
| DOMAIN_25060 | *Ailuropoda melanoleuca* | 1545 | 3.6002 | 4.82E−04 |
| DOMAIN_25063 | *Phascolarctos cinereus* | 1546 | 2.9436 | 0.0042752 |
| DOMAIN_25070 | *Sapajus apella* | 1547 | 2.9649 | 0.0043634 |
| DOMAIN_25091 | *Phascolarctos cinereus* | 1548 | 2.9006 | 0.0039332 |
| DOMAIN_25094 | *Phascolarctos cinereus* | 1549 | 3.0413 | 0.0026876 |
| DOMAIN_25106 | *Canis lupus familiaris* | 1550 | 2.8622 | 0.0075508 |
| DOMAIN_25126 | *Puma concolor* | 1551 | 2.1478 | 0.005514 |
| DOMAIN_25128 | *Sapajus apella* | 1552 | 2.588 | 0.0029475 |
| DOMAIN_25131 | *Sapajus apella* | 1553 | 2.592 | 0.0051895 |
| DOMAIN_25146 | *Macaca nemestrina* | 1554 | 3.629 | 1.68E−06 |
| DOMAIN_25150 | *Muntiacus reevesi* | 1555 | 3.147 | 0.0018391 |
| DOMAIN_25157 | *Myotis brandtii* | 1556 | 3.0902 | 0.0012442 |
| DOMAIN_25194 | *Macaca nemestrina* | 1557 | 2.4613 | 0.003597 |
| DOMAIN_25204 | *Panthera pardus* | 1558 | 2.7595 | 0.0027917 |
| DOMAIN_25234 | *Saimiri boliviensis boliviensis* | 1559 | 2.743 | 0.0042296 |
| DOMAIN_25235 | *Oryctolagus cuniculus* | 1560 | 3.6965 | 1.76E−05 |
| DOMAIN_25334 | *Phascolarctos cinereus* | 1561 | 2.7501 | 0.0096299 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_25384 | *Rhinolophus ferrumequinum* | 1562 | 3.5139 | 8.10E−05 |
| DOMAIN_25389 | *Ursus maritimus* | 1563 | 3.0814 | 6.54E−04 |
| DOMAIN_25400 | *Lynx canadensis* | 1564 | 2.2285 | 3.10E−04 |
| DOMAIN_25410 | *Puma concolor* | 1565 | 2.8699 | 0.0022843 |
| DOMAIN_25443 | *Muntiacus reevesi* | 1566 | 3.2531 | 0.0016615 |
| DOMAIN_25534 | *Ursus maritimus* | 1567 | 2.2698 | 0.0054246 |
| DOMAIN_25554 | *Panthera pardus* | 1568 | 3.0101 | 0.003898 |
| DOMAIN_25564 | *Muntiacus reevesi* | 1569 | 3.4378 | 6.04E−04 |
| DOMAIN_25565 | *Muntiacus reevesi* | 1570 | 2.6133 | 0.0011572 |
| DOMAIN_25623 | *Ursus maritimus* | 1571 | 3.4886 | 2.91E−06 |
| DOMAIN_25628 | *Rhinopithecus bieti* | 1572 | 2.8332 | 0.0022213 |
| DOMAIN_25649 | *Ursus arctos horribilis* | 1573 | 3.6884 | 5.62E−05 |
| DOMAIN_25654 | *Pteropus alecto* | 1574 | 2.2996 | 0.0031144 |
| DOMAIN_25671 | *Muntiacus reevesi* | 1575 | 3.5244 | 1.53E−07 |
| DOMAIN_25682 | *Rhinopithecus bieti* | 1576 | 2.5621 | 0.002108 |
| DOMAIN_25686 | *Panthera pardus* | 1577 | 2.8635 | 0.0031882 |
| DOMAIN_25726 | *Pteropus alecto* | 1578 | 2.8203 | 0.0039506 |
| DOMAIN_25741 | *Sapajus apella* | 1579 | 3.7244 | 1.32E−04 |
| DOMAIN_25780 | *Rhinopithecus bieti* | 1580 | 2.8383 | 0.0018385 |
| DOMAIN_25807 | *Puma concolor* | 1581 | 3.6511 | 0.0018679 |
| DOMAIN_25842 | *Rhinolophus ferrumequinum* | 1582 | 3.0942 | 2.44E−04 |
| DOMAIN_25844 | *Ursus maritimus* | 1583 | 2.5635 | 0.0037997 |
| DOMAIN_25857 | *Balaenoptera acutorostrata scammoni* | 1584 | 2.898 | 0.0026959 |
| DOMAIN_25865 | *Vombatus ursinus* | 1585 | 3.1027 | 0.0066133 |
| DOMAIN_25869 | *Vombatus ursinus* | 1586 | 2.3538 | 0.006932 |
| DOMAIN_25972 | *Geotrypetes seraphini* | 1587 | 3.2178 | 0.0036689 |
| DOMAIN_25973 | *Geotrypetes seraphini* | 1588 | 2.7804 | 0.001766 |
| DOMAIN_25996 | *Geotrypetes seraphini* | 1589 | 3.984 | 1.24E−05 |
| DOMAIN_26010 | *Geotrypetes seraphini* | 1590 | 2.1911 | 0.008383 |
| DOMAIN_26012 | *Geotrypetes seraphini* | 1591 | 2.3532 | 9.70E−04 |
| DOMAIN_26044 | *Geotrypetes seraphini* | 1592 | 2.8874 | 0.0068616 |
| DOMAIN_26103 | *Geotrypetes seraphini* | 1593 | 2.5308 | 0.0033422 |
| DOMAIN_26127 | *Geotrypetes seraphini* | 1594 | 2.5183 | 0.00586 |
| DOMAIN_26131 | *Geotrypetes seraphini* | 1595 | 2.4087 | 0.0068533 |
| DOMAIN_26134 | *Geotrypetes seraphini* | 1596 | 2.4433 | 0.0072939 |
| DOMAIN_26163 | *Geotrypetes seraphini* | 1597 | 2.4527 | 0.0041806 |
| DOMAIN_26177 | *Geotrypetes seraphini* | 1598 | 3.4467 | 1.27E−05 |
| DOMAIN_26180 | *Geotrypetes seraphini* | 1599 | 3.4522 | 1.35E−04 |
| DOMAIN_26194 | *Geotrypetes seraphini* | 1600 | 2.8857 | 0.0031518 |
| DOMAIN_26211 | *Pelodiscus sinensis* | 1601 | 2.6058 | 0.0064871 |
| DOMAIN_26233 | *Colinus virginianus* | 1602 | 3.6739 | 1.77E−04 |
| DOMAIN_26236 | *Pelodiscus sinensis* | 1603 | 2.7094 | 0.003991 |
| DOMAIN_26265 | *Geotrypetes seraphini* | 1604 | 2.5922 | 3.31E−04 |
| DOMAIN_26268 | *Geotrypetes seraphini* | 1605 | 2.1404 | 0.0020397 |
| DOMAIN_26292 | *Geotrypetes seraphini* | 1606 | 2.4722 | 0.0074388 |
| DOMAIN_26299 | *Geotrypetes seraphini* | 1607 | 2.3704 | 0.0058481 |
| DOMAIN_26305 | *Geotrypetes seraphini* | 1608 | 3.0107 | 0.0084216 |
| DOMAIN_26306 | *Geotrypetes seraphini* | 1609 | 2.6178 | 0.0051922 |
| DOMAIN_26335 | *Colinus virginianus* | 1610 | 4.0965 | 3.41E−04 |
| DOMAIN_26340 | *Pelodiscus sinensis* | 1611 | 3.1704 | 0.003352 |
| DOMAIN_26353 | *Pelodiscus sinensis* | 1612 | 3.5785 | 1.16E−04 |
| DOMAIN_26373 | *Pseudonaja textilis* | 1613 | 3.3204 | 5.13E−04 |
| DOMAIN_26407 | *Colinus virginianus* | 1614 | 2.9778 | 0.0049206 |
| DOMAIN_26414 | *Pelodiscus sinensis* | 1615 | 2.9544 | 0.0089308 |
| DOMAIN_26415 | *Pelodiscus sinensis* | 1616 | 2.5032 | 0.0035489 |
| DOMAIN_26416 | *Pelodiscus sinensis* | 1617 | 3.6321 | 4.36E−05 |
| DOMAIN_26417 | *Pelodiscus sinensis* | 1618 | 4.1057 | 4.46E−05 |
| DOMAIN_26423 | *Pelodiscus sinensis* | 1619 | 3.0169 | 0.0025697 |
| DOMAIN_26430 | *Pelodiscus sinensis* | 1620 | 2.6946 | 0.0051824 |
| DOMAIN_26439 | *Pelodiscus sinensis* | 1621 | 3.2468 | 0.0010568 |
| DOMAIN_26463 | *Pelodiscus sinensis* | 1622 | 2.8812 | 0.003427 |
| DOMAIN_26469 | *Pelodiscus sinensis* | 1623 | 3.021 | 5.08E−04 |
| DOMAIN_26496 | *Geotrypetes seraphini* | 1624 | 2.7991 | 0.0040994 |
| DOMAIN_26501 | *Geotrypetes seraphini* | 1625 | 2.6513 | 0.0041882 |
| DOMAIN_26518 | *Geotrypetes seraphini* | 1626 | 2.397 | 0.0087878 |
| DOMAIN_26577 | *Geotrypetes seraphini* | 1627 | 2.4722 | 0.0035247 |
| DOMAIN_26634 | *Gopherus agassizii* | 1628 | 2.8182 | 0.0079972 |
| DOMAIN_26636 | *Gopherus agassizii* | 1629 | 2.6934 | 0.0090052 |
| DOMAIN_26660 | *Phasianus colchicus* | 1630 | 3.201 | 4.90E−04 |
| DOMAIN_26679 | *Paroedura picta* | 1631 | 2.6033 | 0.001326 |
| DOMAIN_26780 | *Meleagris gallopavo* | 1632 | 3.1696 | 0.0031591 |
| DOMAIN_26783 | *Meleagris gallopavo* | 1633 | 3.2848 | 0.0020241 |

TABLE 54-continued

List of 1,597 repressor domain candidates identified from the high-throughput screen assessing dXR repression of the HBEGF gene and subsequent application of the following criteria: p-value <0.01 and $log_2$(fold change) >2

| Domain ID | Species | SEQ ID NO | Log2 (fold change) | P-value |
|---|---|---|---|---|
| DOMAIN_26795 | *Meleagris gallopavo* | 1634 | 3.3538 | 0.001228 |
| DOMAIN_26800 | *Meleagris gallopavo* | 1635 | 3.8197 | 1.62E−04 |
| DOMAIN_26803 | *Aquila chrysaetos chrysaetos* | 1636 | 3.4265 | 0.001246 |
| DOMAIN_26852 | *Mus musculus* | 1637 | 2.8783 | 0.0025253 |
| DOMAIN_26853 | *Mus musculus* | 1638 | 3.6235 | 7.59E−04 |
| DOMAIN_26886 | *Homo sapiens* | 1639 | 3.3209 | 0.0016312 |
| DOMAIN_26925 | *Alligator sinensis* | 1640 | 3.2248 | 0.0036928 |
| DOMAIN_26999 | *Xenopus laevis* | 1641 | 3.4317 | 4.75E−06 |
| DOMAIN_27032 | *Alligator mississippiensis* | 1642 | 3.4805 | 0.0019423 |
| DOMAIN_27285 | *Peromyscus maniculatus bairdii* | 1643 | 3.092 | 5.16E−04 |
| DOMAIN_27498 | *Sus scrofa* | 1644 | 2.9278 | 0.0029754 |
| DOMAIN_27521 | *Suricata suricatta* | 1645 | 2.7447 | 0.0010703 |
| DOMAIN_27563 | *Muntiacus muntjak* | 1646 | 3.6292 | 6.63E−05 |
| DOMAIN_27566 | *Muntiacus muntjak* | 1647 | 2.7825 | 0.0020795 |
| DOMAIN_27579 | *Muntiacus muntjak* | 1648 | 3.8878 | 7.50E−06 |
| DOMAIN_27581 | *Canis lupus familiaris* | 1649 | 2.4582 | 0.0090172 |
| DOMAIN_27639 | *Macaca fascicularis* | 1650 | 2.452 | 0.0032574 |
| DOMAIN_27642 | *Puma concolor* | 1651 | 2.8615 | 0.0015287 |
| DOMAIN_27690 | *Myotis lucifugus* | 1652 | 3.1465 | 0.0012118 |
| DOMAIN_27705 | *Phascolarctos cinereus* | 1653 | 2.5921 | 0.0030483 |
| DOMAIN_27759 | *Bos taurus* | 1654 | 2.2124 | 0.0070756 |
| DOMAIN_27767 | *Callithrix jacchus* | 1655 | 2.2153 | 0.0023952 |
| DOMAIN_27777 | *Odocoileus virginianus texanus* | 1656 | 2.6766 | 0.0067364 |
| DOMAIN_27784 | *Ovis aries* | 1657 | 2.1631 | 0.0040915 |
| DOMAIN_27809 | *Cebus imitator* | 1658 | 2.8715 | 0.0025161 |
| DOMAIN_27827 | *Vulpes vulpes* | 1659 | 3.1318 | 2.13E−05 |
| DOMAIN_27833 | *Callithrix jacchus* | 1660 | 3.0164 | 4.27E−04 |
| DOMAIN_27866 | Orangutan | 1661 | 2.9226 | 0.0029981 |
| DOMAIN_27886 | *Bison bison bison* | 1662 | 2.735 | 0.0036356 |
| DOMAIN_27902 | *Vulpes vulpes* | 1663 | 2.9068 | 0.0039341 |
| DOMAIN_27988 | *Camelus dromedarius* | 1664 | 2.5381 | 0.0015476 |
| DOMAIN_28051 | *Neomonachus schauinslandi* | 1665 | 2.4353 | 0.0018581 |
| DOMAIN_28071 | *Enhydra lutris kenyoni* | 1666 | 3.2938 | 2.61E−04 |
| DOMAIN_28085 | *Enhydra lutris kenyoni* | 1667 | 2.2962 | 0.0029074 |
| DOMAIN_28103 | *Physeter macrocephalus* | 1668 | 2.4116 | 0.009594 |
| DOMAIN_28118 | OwlMonkey | 1669 | 3.1049 | 0.0027807 |
| DOMAIN_28158 | *Odocoileus virginianus texanus* | 1670 | 3.0762 | 0.0016156 |
| DOMAIN_28164 | *Callithrix jacchus* | 1671 | 2.7356 | 0.0064115 |
| DOMAIN_28299 | *Capra hircus* | 1672 | 3.5584 | 6.41E−05 |
| DOMAIN_28309 | *Pteropus vampyrus* | 1673 | 3.5338 | 3.28E−04 |
| DOMAIN_28335 | Bonobo | 1674 | 3.3013 | 2.50E−04 |
| DOMAIN_28341 | *Homo sapiens* | 1675 | 2.7008 | 5.14E−04 |
| DOMAIN_28417 | *Gulo gulo* | 1676 | 2.5366 | 5.02E−04 |
| DOMAIN_28421 | *Erinaceus europaeus* | 1677 | 3.0763 | 0.0038713 |
| DOMAIN_28507 | *Muntiacus reevesi* | 1678 | 3.2874 | 8.76E−04 |
| DOMAIN_28513 | *Propithecus coquereli* | 1679 | 2.3747 | 0.0050076 |
| DOMAIN_28533 | *Propithecus coquereli* | 1680 | 2.7575 | 0.0031303 |
| DOMAIN_28588 | *Rhinolophus ferrumequinum* | 1681 | 2.6131 | 0.0030648 |
| DOMAIN_28619 | *Rhinolophus ferrumequinum* | 1682 | 2.6504 | 0.0027237 |
| DOMAIN_28823 | *Microcaecilia unicolor* | 1683 | 2.331 | 0.0078575 |
| DOMAIN_28845 | *Camelus ferus* | 1684 | 3.0175 | 0.0017733 |
| DOMAIN_28929 | *Mus musculus* | 1685 | 3.1025 | 6.70E−04 |
| DOMAIN_29066 | *Xenopus tropicalis* | 1686 | 2.6393 | 3.67E−04 |
| DOMAIN_29164 | *Chelonia mydas* | 1687 | 2.1345 | 0.0029635 |
| DOMAIN_29260 | *Peromyscus maniculatus bairdii* | 1688 | 2.5127 | 0.0074146 |
| DOMAIN_29339 | *Mesocricetus auratus* | 1689 | 2.9581 | 0.0028165 |
| DOMAIN_29377 | *Mesocricetus auratus* | 1690 | 2.672 | 0.0070692 |
| DOMAIN_29426 | *Mus caroli* | 1691 | 2.0491 | 6.64E−04 |
| DOMAIN_29434 | *Mus caroli* | 1692 | 2.2707 | 0.005184 |
| DOMAIN_29467 | *Mus caroli* | 1693 | 3.4689 | 5.79E−05 |
| DOMAIN_29471 | *Cricetulus griseus* | 1694 | 3.1911 | 4.18E−05 |
| DOMAIN_29511 | *Peromyscus maniculatus bairdii* | 1695 | 3.4739 | 7.00E−05 |
| DOMAIN_29614 | *Peromyscus maniculatus bairdii* | 1696 | 3.4528 | 1.82E−04 |
| DOMAIN_29616 | *Mesocricetus auratus* | 1697 | 2.2807 | 0.0035376 |
| DOMAIN_29765 | *Erinaceus europaeus* | 1698 | 3.3088 | 9.79E−04 |
| DOMAIN_29900 | *Nomascus leucogenys* | 1699 | 2.1583 | 0.0098463 |
| DOMAIN_30185 | *Rhinopithecus roxellana* | 1700 | 3.0766 | 5.83E−05 |
| DOMAIN_30211 | *Bison bison bison* | 1701 | 2.3322 | 0.0023122 |
| DOMAIN_30236 | *Callithrix jacchus* | 1702 | 2.7293 | 0.0021744 |
| DOMAIN_30329 | Rhesus | 1703 | 2.1216 | 0.0099018 |
| DOMAIN_30783 | Chimp | 1704 | 2.952 | 0.001698 |
| DOMAIN_31235 | *Vicugna pacos* | 1705 | 2.2828 | 0.0067045 |
| DOMAIN_31340 | *Homo sapiens* | 1706 | 2.8261 | 0.0021028 |

TABLE 54-continued

List of 1,597 repressor domain candidates identified from the high-throughput screen assessing dXR repression of the HBEGF gene and subsequent application of the following criteria: p-value <0.01 and $\log_2$(fold change) >2

| Domain ID | Species | SEQ ID NO | Log2 (fold change) | P-value |
|---|---|---|---|---|
| DOMAIN_31383 | *Propithecus coquereli* | 1707 | 2.1919 | 0.0087058 |
| DOMAIN_31638 | *Balaenoptera acutorostrata scammoni* | 1708 | 2.0254 | 0.0036297 |
| DOMAIN_31798 | *Notechis scutatus* | 1709 | 4.8007 | 7.82E−04 |
| DOMAIN_31935 | *Rhinolophus ferrumequinum* | 1710 | 3.5544 | 0.0084786 |
| DOMAIN_32127 | Human | 1711 | 3.7547 | 2.62E−05 |
| DOMAIN_32145 | Human | 1712 | 3.1866 | 1.67E−05 |
| DOMAIN_32146 | Human | 1713 | 2.7628 | 0.0016129 |
| DOMAIN_32159 | Human | 1714 | 2.7874 | 0.0021753 |
| DOMAIN_32215 | Human | 1715 | 3.2653 | 0.001461 |
| DOMAIN_32223 | Human | 1716 | 2.8836 | 0.0068873 |
| DOMAIN_32255 | Human | 1717 | 3.8237 | 1.39E−05 |
| DOMAIN_32279 | Human | 1718 | 2.4917 | 0.0060199 |
| DOMAIN_32286 | Human | 1719 | 2.8921 | 0.0070992 |
| DOMAIN_32312 | Human | 1720 | 2.9151 | 0.0030308 |
| DOMAIN_32321 | Human | 1721 | 3.0441 | 0.0040854 |
| DOMAIN_32327 | Human | 1722 | 3.1024 | 0.0044212 |
| DOMAIN_32334 | Human | 1723 | 2.8117 | 0.0015241 |
| DOMAIN_32351 | Human | 1724 | 2.0727 | 0.0036362 |
| DOMAIN_32386 | Human | 1725 | 3.5521 | 3.87E−04 |
| DOMAIN_32390 | Human | 1726 | 3.757 | 4.30E−05 |

The repressor domain with the highest log 2 (fold change) was derived from the king cobra, *Ophiophagus hannah* (DOMAIN_26749; SEQ ID NO: 135). Surprisingly, this sequence was highly divergent from human KRAB domains (with only 41% sequence identity) and was grouped in a sequence cluster of poor repressor domains.

To verify that the domains identified in the selection supported transcriptional repression in an independent assay, representative members of the top 95 and 1597 repressor domains were used to generate dXR constructs, and their ability to repress transcription of the B2M locus was tested. As shown in FIG. 55, seven days after transduction, dXRs with all but one of the representative top 95 or 1597 repressor domains tested repressed B2M to a greater extent than did the dXR with the ZNF10 KRAB domain. As shown in FIG. 56, ten days after transduction, the majority of the dXRs with representative top 95 or 1597 repressor domains tested repressed B2M to a greater extent than did ZNF10 or ZIM3. dXR repression of a target locus tends to deteriorate over time, and ten days following transduction is believed to be a relatively late timepoint for measuring dXR repression. Therefore, it is particularly notable that many of the dXR constructs with repressor domains in the top 95 and 1597 were able to repress B2M to a greater extent than dXR with KRAB domains derived from ZNF10 or ZIM3 as late as ten days following transduction.

To further understand the basis of the superior ability of the identified repressor domains to repress transcription, protein sequence motifs were identified from the top 1597 repressor domains using the STREME algorithm. Specifically, five motifs (motifs 1-5) were generated by comparing the amino acid sequences of the top 1597 repressor domains to a negative training set of 1506 repressor domains with p-values less than 0.01, and log 2 (fold change) values less than 0. Logos of motifs 1-5 are provided in FIGS. 57A, 57B, 57C, 57D, and 57E. In addition, four motifs (motifs 6-9) were generated by comparing the top 1597 repressor domains to shuffled sequences derived from the 1597 repressor domain sequences. Logos of motifs 6-9 are provided in FIGS. 57F, 57G, 57H, and 57I.

Table 55, below, provides the p-value, E-value (a measure of statistical significance), and number and percentage of sequences matching the motif in the top 1597 repressor domains for each of the nine motifs, as calculated by STREME. Table 56 provides the sequences of each motif, showing the amino acid residues present at each position within the motifs (from N- to C-terminus).

TABLE 55

Characteristics of protein sequence motifs of top 1597 repressor domains

| Motif ID | P-value | E-value | Number and percentage of sites matching motif in top 1597 repressor domains |
|---|---|---|---|
| Motifs generated compared to a negative training set | | | |
| 1 | 3.7e−014 | 7.1e−013 | 1158 (72.5%) |
| 2 | 3.4e−012 | 6.4e−011 | 978 (61.2%) |
| 3 | 7.5e−010 | 1.4e−008 | 1017 (63.7%) |
| 4 | 7.0e−008 | 1.3e−006 | 987 (61.8%) |
| 5 | 1.7e−007 | 3.3e−006 | 678 (42.5%) |
| Motifs generated compared to shuffled sequences | | | |
| 6 | 1.2e−048 | 1.5e−047 | 1597 (100.0%) |
| 7 | 1.2e−048 | 1.5e−047 | 1597 (100.0%) |
| 8 | 1.3e−042 | 1.6e−041 | 1377 (86.2%) |
| 9 | 2.1e−040 | 2.7e−039 | 1483 (92.9%) |

TABLE 56

Sequences of protein sequence motifs of top 1597 repressor domains

| Motif ID | Position in motif | Amino acid residues with >5% representation in motif |
|---|---|---|
| Motifs generated compared to a negative training set | | |
| 1 | 1 | P |
| | 2 | A, D, E, N |
| | 3 | L, V |
| | 4 | I, V |
| | 5 | S, T, F |

TABLE 56-continued

Sequences of protein sequence motifs of top 1597 repressor domains

| Motif ID | Position in motif | Amino acid residues with >5% representation in motif |
|---|---|---|
| | 6 | H, K, L, Q, R, W |
| | 7 | L, M |
| | 8 | E |
| | 9 | G, K, Q, R |
| 2 | 1 | L, V |
| | 2 | A, G, L, T, V |
| | 3 | A, F, S |
| | 4 | L, V |
| | 5 | G |
| | 6 | C, F, H, I, L, Y |
| | 7 | A, C, P, Q, S |
| | 8 | A, F, G, I, S, V |
| | 9 | A, P, S, T |
| | 10 | K, R |
| 3 (SEQ ID NO: 1727) | 1 | Q |
| | 2 | K, R |
| | 3 | A, D, E, G, N, S, T |
| | 4 | L |
| | 5 | Y |
| | 6 | R |
| | 7 | D, E, S |
| | 8 | V |
| | 9 | M |
| | 10 | L, R |
| 4 (SEQ ID NO: 1728) | 1 | A, L, P, S |
| | 2 | L, V |
| | 3 | S, T |
| | 4 | F |
| | 5 | A, E, G, K, R |
| | 6 | D |
| | 7 | V |
| | 8 | A, T |
| | 9 | I, V |
| | 10 | D, E, N, Y |
| | 11 | F |
| | 12 | S, T |
| | 13 | E, P, Q, R, W |
| | 14 | E, N |
| | 15 | E, Q |
| 5 | 1 | E, G, R |
| | 2 | E, K |
| | 3 | A, D, E |
| | 4 | P |
| | 5 | C, W |
| | 6 | I, K, L, M, T, V |
| | 7 | I, L, P, V |
| | 8 | D, E, K, V |
| | 9 | E, G, K, P, R |
| | 10 | A, D, R, G, K, Q, V |
| | 11 | D, E, G, I, L, R, S, V |
| Motifs generated compared to shuffled sequences | | |
| 6 (SEQ ID NO: 1729) | 1 | L |
| | 2 | Y |
| | 3 | K, R |
| | 4 | D, E |
| | 5 | V |
| | 6 | M |
| | 7 | L, Q, R |
| | 8 | E |
| | 9 | N, T |
| | 10 | F, Y |
| | 11 | A, E, G, Q, R, S |
| | 12 | H, L, N |
| | 13 | L, V |
| | 14 | A, G, I, L, T, V |
| | 15 | A, F, S |
| 7 (SEQ ID NO: 1730) | 1 | F |
| | 2 | A, E, G, K, R |
| | 3 | D |
| | 4 | V |
| | 5 | A, S, T |
| | 6 | I, V |
| | 7 | D, E, N, Y |
| | 8 | F |
| | 9 | S, T |
| | 10 | E, L, P, Q, R, W |
| | 11 | D, E |
| | 12 | E |
| | 13 | W |
| | 14 | A, E, G, Q, R |
| 8 | 1 | K, R |
| | 2 | P |
| | 3 | A, D, E, N |
| | 4 | I, L, M, V |
| | 5 | I, V |
| | 6 | F, S, T |
| | 7 | H, K, L, Q, R, W |
| | 8 | L |
| | 9 | E |
| | 10 | K, Q, R |
| | 11 | E, G, R |
| | 12 | D, E, K |
| | 13 | A, D, E |
| | 14 | L, P |
| | 15 | C, W |
| 9 | 1 | C, H, L, Q, W |
| | 2 | L |
| | 3 | D, G, N, R, S |
| | 4 | L, P, S, T |
| | 5 | A, S, T |
| | 6 | Q |
| | 7 | K, R |
| | 8 | A, D, E, K, N, S, T |

Notably, motifs 6 and 7 were present in 100% of the top 1597 repressor domains. Many of the highly conserved positions in motif 6 (e.g., amino acid residues L1, Y2, V5, M6, and E8) are known to form an interface with Trim28 (also known as Kap1), which is responsible for recruiting transcriptional repressive machinery to a locus. Similarly, residues in motif 7 (D3, V4, E11, E12) all contribute to Trim28 recruitment. It is believed that many of the amino acid residues identified as enriched in the top repressor domains strengthen Trim28 recruitment. Notably, some of these residues are absent in commonly used KRAB domains. Specifically, in the site in ZNF10 that matches motif 6, the residue at the first position is a valine instead of a leucine. In the site in ZIM3 that matches motif 7, the residue at position 11 is a glycine instead of a glutamic acid. Many of the other motifs described above that are not present in all KRAB domains may represent additional and novel mechanisms of repression that are specific to sequence clusters of repressor domains with homology to KRAB domains.

Taken together, the experiments described herein have identified a suite of non-human transcriptional repressor domains that are effective for promoting transcriptional repression in the context of a dXR molecule. These domains repressed transcription to a greater extent than ZNF10 and ZIM3. Finally, protein sequence motifs were identified that are associated with the domains that were the strongest transcriptional repressors.

Example 18: Members of the Top 95 Repressor Domains Increase LTRP5 Activity

As described in Example 17, non-human repressor domains were identified that resulted in enhanced repression in the context of dXR constructs. Here, experiments were performed to test whether the enhanced repressor domains identified in Example 17 were also superior transcriptional repressors in the context of LTRP5.

Materials and Methods

Representative repressor domains identified in Example 17 and determined to be members of the top 95 performing repressors (Table 65) were cloned into an LTRP5 construct without the DNMT3A ADD domain (FIG. 1). The LTRP5 constructs were constructed as described in Example 13 (Table 45), except that an SV40 NLS was present downstream of the repressor domains. An LTRP5 molecule with a ZIM3 KRAB domain was used as a control. A separate plasmid was used to encode guide scaffold 316 (SEQ ID NO: 1746) with spacer 7.165 (UCCCUAUGUCCUUGCUGUUU; SEQ ID NO: 3114) targeting the B2M locus. Additional controls included a dXR molecule with a ZIM3 KRAB domain with a gRNA having scaffold 316 and spacer 7.165, and LTRP5 and dXR molecules with the ZIM3 KRAB and a non-targeting gRNA. Spacer 7.165 was chosen because it is known to be a relatively inefficient spacer, which would therefore increase the dynamic range of the assay for discerning differences between the various LTRP molecules tested.

HEK293T cells were transfected as described in Example 14, except that the cells were transfected with 50 ng each of a plasmid encoding the LTRP construct and a plasmid encoding the gRNA. Repression analysis was conducted by analyzing B2M protein expression via HLA immunostaining followed by flow cytometry as described in Example 13. 72 of the 95 top repressor domains were assessed together in one experiment where B2M expression was measured at 7, 14, 19, and 26 days after transfection, and the data shown in Tables 57-60. For the remaining 24 repressor domains assessed in a second experiment, B2M expression was measured at 6, 13, 20, and 27 days after transfection, and the data are shown in Tables 61-64. A construct encoding catalytically-active CasX 491, paired with the B2M-targeting spacer 7.37 (SEQ ID NO: 3137) was also included as a control.

Results

The results of the B2M assay are provided in Tables 57-64, below.

TABLE 57

Levels of B2M repression mediated by dXR and LTRP constructs with various repressor domains quantified at 7 days post-transfection.

| Repressor construct | Repressor domain | Spacer | Mean % HLA-negative cells | Standard deviation | Sample size |
|---|---|---|---|---|---|
| dXR | ZIM3 | NT | 7.347 | 1.955 | 15 |
| LTRP5 | ZIM3 | NT | 5.619 | 2.520 | 15 |
| dXR | ZIM3 | 7.165 | 6.334 | 1.335 | 14 |
| LTRP5 | DOMAIN_11029 | 7.165 | 33.467 | 1.290 | 3 |
| LTRP5 | DOMAIN_4968 | 7.165 | 30.133 | 2.804 | 3 |
| LTRP5 | DOMAIN_27811 | 7.165 | 22.633 | 0.643 | 3 |
| LTRP5 | DOMAIN_5066 | 7.165 | 37.833 | 1.026 | 3 |
| LTRP5 | DOMAIN_15126 | 7.165 | 30.333 | 0.306 | 3 |
| LTRP5 | DOMAIN_17358 | 7.165 | 27.767 | 3.062 | 3 |
| LTRP5 | DOMAIN_8503 | 7.165 | 29.700 | 0.889 | 3 |
| LTRP5 | DOMAIN_11486 | 7.165 | 36.667 | 1.320 | 3 |
| LTRP5 | DOMAIN_28803 | 7.165 | 30.367 | 0.902 | 3 |
| LTRP5 | DOMAIN_17317 | 7.165 | 25.933 | 0.586 | 3 |

TABLE 57-continued

Levels of B2M repression mediated by dXR and LTRP constructs with various repressor domains quantified at 7 days post-transfection.

| Repressor construct | Repressor domain | Spacer | Mean % HLA-negative cells | Standard deviation | Sample size |
|---|---|---|---|---|---|
| LTRP5 | DOMAIN_24125 | 7.165 | 32.667 | 1.290 | 3 |
| LTRP5 | DOMAIN_8853 | 7.165 | 48.100 | 4.458 | 3 |
| LTRP5 | DOMAIN_19949 | 7.165 | 31.967 | 2.511 | 3 |
| LTRP5 | DOMAIN_737 | 7.165 | 41.467 | 3.258 | 3 |
| LTRP5 | DOMAIN_16444 | 7.165 | 36.367 | 1.704 | 3 |
| LTRP5 | DOMAIN_11386 | 7.165 | 35.633 | 1.677 | 3 |
| LTRP5 | DOMAIN_27506 | 7.165 | 39.467 | 1.504 | 3 |
| LTRP5 | DOMAIN_10331 | 7.165 | 38.300 | 1.308 | 3 |
| LTRP5 | DOMAIN_13539 | 7.165 | 40.800 | 2.307 | 3 |
| LTRP5 | DOMAIN_2380 | 7.165 | 41.100 | 1.277 | 3 |
| LTRP5 | DOMAIN_18258 | 7.165 | 29.133 | 0.777 | 3 |
| LTRP5 | DOMAIN_23723 | 7.165 | 33.400 | 2.170 | 3 |
| LTRP5 | DOMAIN_16806 | 7.165 | 35.667 | 1.450 | 3 |
| LTRP5 | DOMAIN_18216 | 7.165 | 41.400 | 0.819 | 3 |
| LTRP5 | DOMAIN_17432 | 7.165 | 43.967 | 0.907 | 3 |
| LTRP5 | DOMAIN_4806 | 7.165 | 36.767 | 1.747 | 3 |
| LTRP5 | DOMAIN_25379 | 7.165 | 46.467 | 3.868 | 3 |
| LTRP5 | DOMAIN_16643 | 7.165 | 41.133 | 1.206 | 3 |
| LTRP5 | DOMAIN_21603 | 7.165 | 34.367 | 0.404 | 3 |
| LTRP5 | DOMAIN_21247 | 7.165 | 37.867 | 2.219 | 3 |
| LTRP5 | DOMAIN_28640 | 7.165 | 39.900 | 1.277 | 3 |
| LTRP5 | ZIM3 | 7.165 | 31.940 | 1.637 | 15 |
| LTRP5 | DOMAIN_14659 | 7.165 | 37.933 | 1.767 | 3 |
| LTRP5 | DOMAIN_6248 | 7.165 | 36.000 | 2.352 | 3 |
| LTRP5 | DOMAIN_11348 | 7.165 | 38.433 | 1.286 | 3 |
| LTRP5 | DOMAIN_19229 | 7.165 | 33.967 | 0.321 | 3 |
| LTRP5 | DOMAIN_17759 | 7.165 | 43.233 | 0.924 | 3 |
| LTRP5 | DOMAIN_24663 | 7.165 | 39.433 | 6.048 | 3 |
| LTRP5 | DOMAIN_18137 | 7.165 | 44.033 | 0.404 | 3 |
| LTRP5 | DOMAIN_13331 | 7.165 | 38.700 | 2.163 | 3 |
| LTRP5 | DOMAIN_6807 | 7.165 | 39.500 | 0.436 | 3 |
| LTRP5 | DOMAIN_16688 | 7.165 | 41.800 | 0.265 | 3 |
| LTRP5 | DOMAIN_26322 | 7.165 | 42.767 | 4.661 | 3 |
| LTRP5 | DOMAIN_6802 | 7.165 | 45.767 | 1.888 | 3 |
| LTRP5 | DOMAIN_22270 | 7.165 | 32.500 | 1.100 | 3 |
| LTRP5 | DOMAIN_7255 | 7.165 | 43.567 | 0.451 | 3 |
| LTRP5 | DOMAIN_5463 | 7.165 | 32.533 | 0.404 | 3 |
| LTRP5 | DOMAIN_12631 | 7.165 | 40.300 | 0.624 | 3 |
| LTRP5 | DOMAIN_9960 | 7.165 | 43.967 | 2.363 | 3 |
| LTRP5 | DOMAIN_6445 | 7.165 | 45.667 | 2.730 | 3 |
| LTRP5 | DOMAIN_23394 | 7.165 | 40.733 | 2.285 | 3 |
| LTRP5 | DOMAIN_10948 | 7.165 | 42.733 | 0.924 | 3 |
| LTRP5 | DOMAIN_19804 | 7.165 | 42.067 | 1.914 | 3 |
| LTRP5 | DOMAIN_5290 | 7.165 | 43.400 | 1.136 | 3 |
| LTRP5 | DOMAIN_24458 | 7.165 | 43.567 | 1.332 | 3 |
| LTRP5 | DOMAIN_19896 | 7.165 | 43.600 | 0.624 | 3 |
| LTRP5 | DOMAIN_21755 | 7.165 | 38.667 | 1.498 | 3 |
| LTRP5 | DOMAIN_8790 | 7.165 | 34.900 | 0.608 | 3 |
| LTRP5 | DOMAIN_881 | 7.165 | 43.533 | 1.858 | 3 |
| LTRP5 | DOMAIN_14755 | 7.165 | 37.350 | 0.071 | 2 |
| LTRP5 | DOMAIN_20505 | 7.165 | 45.367 | 0.569 | 3 |
| LTRP5 | DOMAIN_9114 | 7.165 | 43.267 | 1.501 | 3 |
| LTRP5 | DOMAIN_13468 | 7.165 | 43.700 | 1.572 | 3 |
| LTRP5 | DOMAIN_11683 | 7.165 | 40.267 | 0.153 | 3 |
| LTRP5 | DOMAIN_22153 | 7.165 | 46.833 | 0.643 | 3 |
| LTRP5 | DOMAIN_25289 | 7.165 | 38.533 | 0.945 | 3 |
| LTRP5 | DOMAIN_17905 | 7.165 | 36.933 | 1.447 | 3 |
| LTRP5 | DOMAIN_221 | 7.165 | 43.433 | 0.751 | 3 |
| LTRP5 | DOMAIN_7694 | 7.165 | 52.400 | 0.436 | 3 |
| LTRP5 | DOMAIN_15507 | 7.165 | 44.067 | 0.907 | 3 |
| LTRP5 | DOMAIN_29304 | 7.165 | 51.700 | 1.400 | 3 |
| LTRP5 | DOMAIN_10123 | 7.165 | 47.833 | 0.666 | 3 |
| LTRP5 | DOMAIN_30173 | 7.165 | 53.900 | 0.100 | 3 |

TABLE 58

Levels of B2M repression mediated by dXR and LTRP constructs with various repressor domains quantified at 14 days post-transfection.

| Repressor construct | Repressor domain | Spacer | Mean % HLA-negative cells | Standard deviation | Sample size |
|---|---|---|---|---|---|
| dXR | ZIM3 | NT | 1.768 | 0.862 | 15 |
| LTRP5 | ZIM3 | NT | 2.902 | 0.966 | 15 |
| dXR | ZIM3 | 7.165 | 3.397 | 3.091 | 15 |
| LTRP5 | DOMAIN_11029 | 7.165 | 14.667 | 1.620 | 3 |
| LTRP5 | DOMAIN_4968 | 7.165 | 18.933 | 1.557 | 3 |
| LTRP5 | DOMAIN_27811 | 7.165 | 15.100 | 0.854 | 3 |
| LTRP5 | DOMAIN_5066 | 7.165 | 21.133 | 1.286 | 3 |
| LTRP5 | DOMAIN_15126 | 7.165 | 18.767 | 2.060 | 3 |
| LTRP5 | DOMAIN_17358 | 7.165 | 16.667 | 1.815 | 3 |
| LTRP5 | DOMAIN_8503 | 7.165 | 17.367 | 1.582 | 3 |
| LTRP5 | DOMAIN_11486 | 7.165 | 21.567 | 2.401 | 3 |
| LTRP5 | DOMAIN_28803 | 7.165 | 20.533 | 0.666 | 3 |
| LTRP5 | DOMAIN_17317 | 7.165 | 18.833 | 1.358 | 3 |
| LTRP5 | DOMAIN_24125 | 7.165 | 23.767 | 0.321 | 3 |
| LTRP5 | DOMAIN_8853 | 7.165 | 25.250 | 0.212 | 2 |
| LTRP5 | DOMAIN_19949 | 7.165 | 23.633 | 1.767 | 3 |
| LTRP5 | DOMAIN_737 | 7.165 | 26.767 | 2.589 | 3 |
| LTRP5 | DOMAIN_16444 | 7.165 | 25.267 | 0.862 | 3 |
| LTRP5 | DOMAIN_11386 | 7.165 | 26.800 | 1.868 | 3 |
| LTRP5 | DOMAIN_27506 | 7.165 | 26.267 | 1.501 | 3 |
| LTRP5 | DOMAIN_10331 | 7.165 | 25.733 | 1.286 | 3 |
| LTRP5 | DOMAIN_13539 | 7.165 | 28.700 | 2.152 | 3 |
| LTRP5 | DOMAIN_2380 | 7.165 | 27.533 | 1.858 | 3 |
| LTRP5 | DOMAIN_18258 | 7.165 | 21.967 | 0.777 | 3 |
| LTRP5 | DOMAIN_23723 | 7.165 | 23.333 | 1.501 | 3 |
| LTRP5 | DOMAIN_16806 | 7.165 | 26.367 | 2.060 | 3 |
| LTRP5 | DOMAIN_18216 | 7.165 | 27.667 | 1.358 | 3 |
| LTRP5 | DOMAIN_17432 | 7.165 | 29.433 | 0.462 | 3 |
| LTRP5 | DOMAIN_4806 | 7.165 | 25.500 | 2.272 | 3 |
| LTRP5 | DOMAIN_25379 | 7.165 | 29.450 | 2.051 | 2 |
| LTRP5 | DOMAIN_16643 | 7.165 | 26.333 | 1.890 | 3 |
| LTRP5 | DOMAIN_21603 | 7.165 | 31.367 | 4.219 | 3 |
| LTRP5 | DOMAIN_21247 | 7.165 | 29.467 | 0.651 | 3 |
| LTRP5 | DOMAIN_28640 | 7.165 | 28.133 | 1.350 | 3 |
| LTRP5 | ZIM3 | 7.165 | 25.287 | 1.914 | 15 |
| LTRP5 | DOMAIN_14659 | 7.165 | 28.167 | 2.676 | 3 |
| LTRP5 | DOMAIN_6248 | 7.165 | 25.433 | 0.115 | 3 |
| LTRP5 | DOMAIN_11348 | 7.165 | 29.433 | 2.501 | 3 |
| LTRP5 | DOMAIN_19229 | 7.165 | 25.367 | 1.656 | 3 |
| LTRP5 | DOMAIN_17759 | 7.165 | 29.867 | 1.250 | 3 |
| LTRP5 | DOMAIN_24663 | 7.165 | 30.500 | 1.323 | 3 |
| LTRP5 | DOMAIN_18137 | 7.165 | 28.967 | 0.839 | 3 |
| LTRP5 | DOMAIN_13331 | 7.165 | 29.333 | 1.701 | 3 |
| LTRP5 | DOMAIN_6807 | 7.165 | 28.133 | 0.208 | 3 |
| LTRP5 | DOMAIN_16688 | 7.165 | 29.667 | 0.153 | 3 |
| LTRP5 | DOMAIN_26322 | 7.165 | 30.033 | 8.565 | 3 |
| LTRP5 | DOMAIN_6802 | 7.165 | 30.900 | 1.670 | 3 |
| LTRP5 | DOMAIN_22270 | 7.165 | 26.967 | 2.967 | 3 |
| LTRP5 | DOMAIN_7255 | 7.165 | 31.500 | 2.536 | 3 |
| LTRP5 | DOMAIN_5463 | 7.165 | 24.167 | 1.358 | 3 |
| LTRP5 | DOMAIN_12631 | 7.165 | 31.967 | 2.108 | 3 |
| LTRP5 | DOMAIN_9960 | 7.165 | 31.900 | 1.493 | 3 |
| LTRP5 | DOMAIN_6445 | 7.165 | 34.533 | 1.484 | 3 |
| LTRP5 | DOMAIN_23394 | 7.165 | 25.767 | 0.666 | 3 |
| LTRP5 | DOMAIN_10948 | 7.165 | 34.267 | 1.750 | 3 |
| LTRP5 | DOMAIN_19804 | 7.165 | 32.567 | 2.212 | 3 |
| LTRP5 | DOMAIN_5290 | 7.165 | 34.967 | 2.810 | 3 |
| LTRP5 | DOMAIN_24458 | 7.165 | 30.433 | 1.762 | 3 |
| LTRP5 | DOMAIN_19896 | 7.165 | 32.200 | 0.954 | 3 |
| LTRP5 | DOMAIN_21755 | 7.165 | 27.867 | 3.630 | 3 |
| LTRP5 | DOMAIN_8790 | 7.165 | 25.033 | 0.058 | 3 |
| LTRP5 | DOMAIN_881 | 7.165 | 27.533 | 0.987 | 3 |
| LTRP5 | DOMAIN_14755 | 7.165 | 29.867 | 0.404 | 3 |
| LTRP5 | DOMAIN_20505 | 7.165 | 35.733 | 1.150 | 3 |
| LTRP5 | DOMAIN_9114 | 7.165 | 34.467 | 0.981 | 3 |
| LTRP5 | DOMAIN_13468 | 7.165 | 28.633 | 1.721 | 3 |
| LTRP5 | DOMAIN_11683 | 7.165 | 32.333 | 0.757 | 3 |
| LTRP5 | DOMAIN_22153 | 7.165 | 34.533 | 3.592 | 3 |
| LTRP5 | DOMAIN_25289 | 7.165 | 30.467 | 2.495 | 3 |
| LTRP5 | DOMAIN_17905 | 7.165 | 32.800 | 0.529 | 3 |
| LTRP5 | DOMAIN_221 | 7.165 | 33.233 | 1.012 | 3 |
| LTRP5 | DOMAIN_7694 | 7.165 | 42.367 | 1.531 | 3 |
| LTRP5 | DOMAIN_15507 | 7.165 | 34.600 | 2.600 | 3 |
| LTRP5 | DOMAIN_29304 | 7.165 | 42.067 | 2.948 | 3 |
| LTRP5 | DOMAIN_10123 | 7.165 | 39.667 | 2.984 | 3 |
| LTRP5 | DOMAIN_30173 | 7.165 | 49.167 | 1.266 | 3 |

TABLE 59

Levels of B2M repression mediated by dXR and LTRP constructs with various repressor domains quantified at 19 days post-transfection.

| Repressor construct | Repressor domain | Spacer | Mean % HLA-negative cells | Standard deviation | Sample size |
|---|---|---|---|---|---|
| dXR | ZIM3 | NT | 7.326 | 4.796 | 15 |
| LTRP5 | ZIM3 | NT | 6.060 | 4.855 | 15 |
| dXR | ZIM3 | 7.165 | 10.038 | 10.782 | 15 |
| LTRP5 | DOMAIN_11029 | 7.165 | 10.257 | 1.970 | 3 |
| LTRP5 | DOMAIN_4968 | 7.165 | 14.333 | 2.579 | 3 |
| LTRP5 | DOMAIN_27811 | 7.165 | 13.200 | 1.212 | 3 |
| LTRP5 | DOMAIN_5066 | 7.165 | 15.800 | 0.781 | 3 |
| LTRP5 | DOMAIN_15126 | 7.165 | 17.133 | 1.097 | 3 |
| LTRP5 | DOMAIN_17358 | 7.165 | 22.700 | 2.364 | 3 |
| LTRP5 | DOMAIN_8503 | 7.165 | 12.267 | 2.285 | 3 |
| LTRP5 | DOMAIN_11486 | 7.165 | 16.600 | 2.138 | 3 |
| LTRP5 | DOMAIN_28803 | 7.165 | 15.200 | 0.300 | 3 |
| LTRP5 | DOMAIN_17317 | 7.165 | 17.267 | 1.026 | 3 |
| LTRP5 | DOMAIN_24125 | 7.165 | 19.700 | 1.652 | 3 |
| LTRP5 | DOMAIN_8853 | 7.165 | 21.333 | 3.842 | 3 |
| LTRP5 | DOMAIN_19949 | 7.165 | 16.600 | 1.082 | 3 |
| LTRP5 | DOMAIN_737 | 7.165 | 19.367 | 1.168 | 3 |
| LTRP5 | DOMAIN_16444 | 7.165 | 20.433 | 2.026 | 3 |
| LTRP5 | DOMAIN_11386 | 7.165 | 19.333 | 0.924 | 3 |
| LTRP5 | DOMAIN_27506 | 7.165 | 23.300 | 1.970 | 3 |
| LTRP5 | DOMAIN_10331 | 7.165 | 22.800 | 2.007 | 3 |
| LTRP5 | DOMAIN_13539 | 7.165 | 24.267 | 2.150 | 3 |
| LTRP5 | DOMAIN_2380 | 7.165 | 25.067 | 3.668 | 3 |
| LTRP5 | DOMAIN_18258 | 7.165 | 21.467 | 2.344 | 3 |
| LTRP5 | DOMAIN_23723 | 7.165 | 20.367 | 3.329 | 3 |
| LTRP5 | DOMAIN_16806 | 7.165 | 22.267 | 1.656 | 3 |
| LTRP5 | DOMAIN_18216 | 7.165 | 22.200 | 2.193 | 3 |
| LTRP5 | DOMAIN_17432 | 7.165 | 25.967 | 0.404 | 3 |
| LTRP5 | DOMAIN_4806 | 7.165 | 20.133 | 2.593 | 3 |
| LTRP5 | DOMAIN_25379 | 7.165 | 26.400 | 4.583 | 3 |
| LTRP5 | DOMAIN_16643 | 7.165 | 24.733 | 2.205 | 3 |
| LTRP5 | DOMAIN_21603 | 7.165 | 24.500 | 5.186 | 3 |
| LTRP5 | DOMAIN_21247 | 7.165 | 23.667 | 1.002 | 3 |
| LTRP5 | DOMAIN_28640 | 7.165 | 26.767 | 3.880 | 3 |
| LTRP5 | ZIM3 | 7.165 | 22.520 | 3.682 | 15 |
| LTRP5 | DOMAIN_14659 | 7.165 | 26.067 | 3.386 | 3 |
| LTRP5 | DOMAIN_6248 | 7.165 | 26.833 | 4.140 | 3 |
| LTRP5 | DOMAIN_11348 | 7.165 | 24.400 | 2.476 | 3 |
| LTRP5 | DOMAIN_19229 | 7.165 | 23.133 | 1.858 | 3 |
| LTRP5 | DOMAIN_17759 | 7.165 | 27.667 | 0.902 | 3 |
| LTRP5 | DOMAIN_24663 | 7.165 | 26.667 | 5.493 | 3 |
| LTRP5 | DOMAIN_18137 | 7.165 | 23.967 | 1.206 | 3 |
| LTRP5 | DOMAIN_13331 | 7.165 | 23.367 | 1.626 | 3 |
| LTRP5 | DOMAIN_6807 | 7.165 | 23.700 | 0.265 | 3 |
| LTRP5 | DOMAIN_16688 | 7.165 | 26.367 | 1.930 | 3 |
| LTRP5 | DOMAIN_26322 | 7.165 | 25.367 | 8.700 | 3 |
| LTRP5 | DOMAIN_6802 | 7.165 | 45.967 | 33.520 | 3 |
| LTRP5 | DOMAIN_22270 | 7.165 | 21.133 | 0.709 | 3 |
| LTRP5 | DOMAIN_7255 | 7.165 | 30.267 | 2.103 | 3 |
| LTRP5 | DOMAIN_5463 | 7.165 | 18.033 | 1.893 | 3 |
| LTRP5 | DOMAIN_12631 | 7.165 | 29.100 | 2.516 | 3 |

TABLE 59-continued

Levels of B2M repression mediated by dXR and LTRP constructs with various repressor domains quantified at 19 days post-transfection.

| Repressor construct | Repressor domain | Spacer | Mean % HLA-negative cells | Standard deviation | Sample size |
|---|---|---|---|---|---|
| LTRP5 | DOMAIN_9960 | 7.165 | 29.067 | 3.134 | 3 |
| LTRP5 | DOMAIN_6445 | 7.165 | 31.267 | 2.040 | 3 |
| LTRP5 | DOMAIN_23394 | 7.165 | 25.267 | 2.957 | 3 |
| LTRP5 | DOMAIN_10948 | 7.165 | 29.400 | 1.473 | 3 |
| LTRP5 | DOMAIN_19804 | 7.165 | 26.400 | 1.442 | 3 |
| LTRP5 | DOMAIN_5290 | 7.165 | 29.133 | 1.021 | 3 |
| LTRP5 | DOMAIN_24458 | 7.165 | 25.600 | 2.500 | 3 |
| LTRP5 | DOMAIN_19896 | 7.165 | 28.600 | 1.997 | 3 |
| LTRP5 | DOMAIN_21755 | 7.165 | 30.233 | 1.185 | 3 |
| LTRP5 | DOMAIN_8790 | 7.165 | 20.733 | 0.723 | 3 |
| LTRP5 | DOMAIN_881 | 7.165 | 34.400 | 3.378 | 3 |
| LTRP5 | DOMAIN_14755 | 7.165 | 25.000 | 1.700 | 3 |
| LTRP5 | DOMAIN_20505 | 7.165 | 33.800 | 2.095 | 3 |
| LTRP5 | DOMAIN_9114 | 7.165 | 28.533 | 0.961 | 3 |
| LTRP5 | DOMAIN_13468 | 7.165 | 31.333 | 3.580 | 3 |
| LTRP5 | DOMAIN_11683 | 7.165 | 29.533 | 2.219 | 3 |
| LTRP5 | DOMAIN_22153 | 7.165 | 32.167 | 3.383 | 3 |
| LTRP5 | DOMAIN_25289 | 7.165 | 31.233 | 1.890 | 3 |
| LTRP5 | DOMAIN_17905 | 7.165 | 40.933 | 5.052 | 3 |
| LTRP5 | DOMAIN_221 | 7.165 | 33.933 | 1.662 | 3 |
| LTRP5 | DOMAIN_7694 | 7.165 | 38.067 | 2.003 | 3 |
| LTRP5 | DOMAIN_15507 | 7.165 | 31.633 | 3.609 | 3 |
| LTRP5 | DOMAIN_29304 | 7.165 | 36.900 | 4.424 | 3 |
| LTRP5 | DOMAIN_10123 | 7.165 | 45.250 | 0.212 | 2 |
| LTRP5 | DOMAIN_30173 | 7.165 | 42.200 | 1.414 | 2 |

TABLE 60

Levels of B2M repression mediated by dXR and LTRP constructs with various repressor domains quantified at 26 days post-transfection.

| Repressor construct | Repressor domain | Spacer | Mean % HLA-negative cells | Standard deviation | Sample size |
|---|---|---|---|---|---|
| dXR | ZIM3 | NT | 3.113 | 3.228 | 15 |
| LTRP5 | ZIM3 | NT | 4.327 | 3.294 | 15 |
| dXR | ZIM3 | 7.165 | 6.341 | 4.981 | 15 |
| LTRP5 | DOMAIN_11029 | 7.165 | 8.727 | 0.401 | 3 |
| LTRP5 | DOMAIN_4968 | 7.165 | 9.963 | 0.616 | 3 |
| LTRP5 | DOMAIN_27811 | 7.165 | 10.480 | 1.753 | 3 |
| LTRP5 | DOMAIN_5066 | 7.165 | 11.633 | 1.790 | 3 |
| LTRP5 | DOMAIN_15126 | 7.165 | 11.897 | 2.133 | 3 |
| LTRP5 | DOMAIN_17358 | 7.165 | 12.700 | 2.022 | 3 |
| LTRP5 | DOMAIN_8503 | 7.165 | 13.000 | 1.480 | 3 |
| LTRP5 | DOMAIN_11486 | 7.165 | 13.300 | 2.762 | 3 |
| LTRP5 | DOMAIN_28803 | 7.165 | 13.433 | 1.626 | 3 |
| LTRP5 | DOMAIN_17317 | 7.165 | 14.333 | 2.346 | 3 |
| LTRP5 | DOMAIN_24125 | 7.165 | 14.967 | 0.961 | 3 |
| LTRP5 | DOMAIN_8853 | 7.165 | 15.333 | 1.531 | 3 |
| LTRP5 | DOMAIN_19949 | 7.165 | 15.600 | 1.082 | 3 |
| LTRP5 | DOMAIN_737 | 7.165 | 16.600 | 1.127 | 3 |
| LTRP5 | DOMAIN_16444 | 7.165 | 17.067 | 0.833 | 3 |
| LTRP5 | DOMAIN_11386 | 7.165 | 17.633 | 1.270 | 3 |
| LTRP5 | DOMAIN_27506 | 7.165 | 17.667 | 1.450 | 3 |
| LTRP5 | DOMAIN_10331 | 7.165 | 18.033 | 2.055 | 3 |
| LTRP5 | DOMAIN_13539 | 7.165 | 18.100 | 2.390 | 3 |
| LTRP5 | DOMAIN_2380 | 7.165 | 18.133 | 0.723 | 3 |
| LTRP5 | DOMAIN_18258 | 7.165 | 18.200 | 1.852 | 3 |
| LTRP5 | DOMAIN_23723 | 7.165 | 18.667 | 1.290 | 3 |
| LTRP5 | DOMAIN_16806 | 7.165 | 18.800 | 2.718 | 3 |
| LTRP5 | DOMAIN_18216 | 7.165 | 19.333 | 2.802 | 3 |
| LTRP5 | DOMAIN_17432 | 7.165 | 19.367 | 1.626 | 3 |
| LTRP5 | DOMAIN_4806 | 7.165 | 19.400 | 2.022 | 3 |
| LTRP5 | DOMAIN_25379 | 7.165 | 19.667 | 5.994 | 3 |
| LTRP5 | DOMAIN_16643 | 7.165 | 19.833 | 1.550 | 3 |

TABLE 60-continued

Levels of B2M repression mediated by dXR and LTRP constructs with various repressor domains quantified at 26 days post-transfection.

| Repressor construct | Repressor domain | Spacer | Mean % HLA-negative cells | Standard deviation | Sample size |
|---|---|---|---|---|---|
| LTRP5 | DOMAIN_21603 | 7.165 | 20.033 | 3.482 | 3 |
| LTRP5 | DOMAIN_21247 | 7.165 | 20.067 | 0.473 | 3 |
| LTRP5 | DOMAIN_28640 | 7.165 | 20.500 | 2.587 | 3 |
| LTRP5 | ZIM3 | 7.165 | 20.607 | 4.413 | 15 |
| LTRP5 | DOMAIN_14659 | 7.165 | 20.633 | 2.371 | 3 |
| LTRP5 | DOMAIN_6248 | 7.165 | 20.867 | 1.193 | 3 |
| LTRP5 | DOMAIN_11348 | 7.165 | 21.367 | 3.811 | 3 |
| LTRP5 | DOMAIN_19229 | 7.165 | 21.533 | 1.266 | 3 |
| LTRP5 | DOMAIN_17759 | 7.165 | 21.567 | 0.833 | 3 |
| LTRP5 | DOMAIN_24663 | 7.165 | 21.633 | 1.701 | 3 |
| LTRP5 | DOMAIN_18137 | 7.165 | 21.833 | 1.097 | 3 |
| LTRP5 | DOMAIN_13331 | 7.165 | 21.900 | 1.153 | 3 |
| LTRP5 | DOMAIN_6807 | 7.165 | 21.900 | 1.735 | 3 |
| LTRP5 | DOMAIN_16688 | 7.165 | 22.200 | 2.265 | 3 |
| LTRP5 | DOMAIN_26322 | 7.165 | 22.233 | 11.832 | 3 |
| LTRP5 | DOMAIN_6802 | 7.165 | 22.433 | 1.150 | 3 |
| LTRP5 | DOMAIN_22270 | 7.165 | 22.533 | 2.084 | 3 |
| LTRP5 | DOMAIN_7255 | 7.165 | 22.867 | 4.271 | 3 |
| LTRP5 | DOMAIN_5463 | 7.165 | 22.900 | 2.516 | 3 |
| LTRP5 | DOMAIN_12631 | 7.165 | 23.433 | 2.641 | 3 |
| LTRP5 | DOMAIN_9960 | 7.165 | 23.500 | 3.996 | 3 |
| LTRP5 | DOMAIN_6445 | 7.165 | 23.633 | 3.308 | 3 |
| LTRP5 | DOMAIN_23394 | 7.165 | 23.900 | 1.127 | 3 |
| LTRP5 | DOMAIN_10948 | 7.165 | 23.900 | 2.166 | 3 |
| LTRP5 | DOMAIN_19804 | 7.165 | 24.133 | 1.966 | 3 |
| LTRP5 | DOMAIN_5290 | 7.165 | 24.233 | 2.139 | 3 |
| LTRP5 | DOMAIN_24458 | 7.165 | 24.367 | 1.531 | 3 |
| LTRP5 | DOMAIN_19896 | 7.165 | 24.633 | 1.361 | 3 |
| LTRP5 | DOMAIN_21755 | 7.165 | 25.333 | 1.097 | 3 |
| LTRP5 | DOMAIN_8790 | 7.165 | 25.567 | 1.320 | 3 |
| LTRP5 | DOMAIN_881 | 7.165 | 26.367 | 0.208 | 3 |
| LTRP5 | DOMAIN_14755 | 7.165 | 26.867 | 1.563 | 3 |
| LTRP5 | DOMAIN_20505 | 7.165 | 27.467 | 3.101 | 3 |
| LTRP5 | DOMAIN_9114 | 7.165 | 28.100 | 0.872 | 3 |
| LTRP5 | DOMAIN_13468 | 7.165 | 28.100 | 2.663 | 3 |
| LTRP5 | DOMAIN_11683 | 7.165 | 28.300 | 1.300 | 3 |
| LTRP5 | DOMAIN_22153 | 7.165 | 28.500 | 3.716 | 3 |
| LTRP5 | DOMAIN_25289 | 7.165 | 28.600 | 3.579 | 3 |
| LTRP5 | DOMAIN_17905 | 7.165 | 30.367 | 0.839 | 3 |
| LTRP5 | DOMAIN_221 | 7.165 | 31.433 | 3.707 | 3 |
| LTRP5 | DOMAIN_7694 | 7.165 | 32.833 | 2.517 | 3 |
| LTRP5 | DOMAIN_15507 | 7.165 | 32.933 | 3.011 | 3 |
| LTRP5 | DOMAIN_29304 | 7.165 | 32.933 | 4.409 | 3 |
| LTRP5 | DOMAIN_10123 | 7.165 | 35.500 | 4.814 | 3 |
| LTRP5 | DOMAIN_30173 | 7.165 | 41.967 | 2.318 | 3 |

TABLE 61

Levels of B2M repression mediated by dXR and LTRP constructs with various repressor domains quantified at 6 days post-transfection.

| Construct | Repressor domain | Spacer | Mean % HLA-negative cells | Standard deviation | Sample size |
|---|---|---|---|---|---|
| dXR | ZIM3 | 7.165 | 7.165 | 2.389 | 6 |
| dXR | ZIM3 | NT | 3.625 | 0.408 | 6 |
| LTRP5 | ZIM3 | NT | 5.888 | 0.976 | 6 |
| LTRP5 | DOMAIN_31643 | 7.165 | 15.633 | 0.551 | 3 |
| LTRP5 | DOMAIN_19460 | 7.165 | 17.133 | 0.231 | 3 |
| LTRP5 | DOMAIN_26732 | 7.165 | 21.333 | 0.751 | 3 |
| LTRP5 | DOMAIN_18563 | 7.165 | 21.700 | 1.100 | 3 |
| LTRP5 | DOMAIN_19892 | 7.165 | 21.967 | 0.569 | 3 |
| LTRP5 | DOMAIN_21317 | 7.165 | 25.633 | 0.416 | 3 |
| LTRP5 | DOMAIN_9114 | 7.165 | 23.233 | 0.907 | 3 |
| LTRP5 | DOMAIN_10277 | 7.165 | 22.900 | 0.361 | 3 |
| LTRP5 | DOMAIN_27060 | 7.165 | 26.533 | 0.666 | 3 |

TABLE 61-continued

Levels of B2M repression mediated by dXR and LTRP constructs with various repressor domains quantified at 6 days post-transfection.

| Construct | Repressor domain | Spacer | Mean % HLA-negative cells | Standard deviation | Sample size |
|---|---|---|---|---|---|
| LTRP5 | DOMAIN_12452 | 7.165 | 26.900 | 1.510 | 3 |
| LTRP5 | DOMAIN_21336 | 7.165 | 23.533 | 0.961 | 3 |
| LTRP5 | DOMAIN_30661 | 7.165 | 24.867 | 1.801 | 3 |
| LTRP5 | DOMAIN_12292 | 7.165 | 30.700 | 0.436 | 3 |
| LTRP5 | DOMAIN_8853 | 7.165 | 31.167 | 0.987 | 3 |
| LTRP5 | DOMAIN_9538 | 7.165 | 29.800 | 1.952 | 3 |
| LTRP5 | DOMAIN_19821 | 7.165 | 26.200 | 1.652 | 3 |
| LTRP5 | ZIM3 | 7.165 | 23.083 | 3.178 | 6 |
| LTRP5 | DOMAIN_26070 | 7.165 | 29.433 | 2.272 | 3 |
| LTRP5 | DOMAIN_19476 | 7.165 | 27.867 | 0.808 | 3 |
| LTRP5 | DOMAIN_4687 | 7.165 | 30.133 | 0.808 | 3 |
| LTRP5 | DOMAIN_25405 | 7.165 | 33.467 | 1.097 | 3 |
| LTRP5 | DOMAIN_10577 | 7.165 | 28.933 | 0.473 | 3 |
| LTRP5 | DOMAIN_2942 | 7.165 | 30.633 | 1.429 | 3 |
| LTRP5 | DOMAIN_27604 | 7.165 | 28.700 | 1.300 | 3 |
| LTRP5 | DOMAIN_7694 | 7.165 | 36.633 | 0.666 | 3 |
| LTRP5 | DOMAIN_29304 | 7.165 | 34.933 | 0.289 | 3 |
| LTRP5 | DOMAIN_9331 | 7.165 | 37.733 | 0.321 | 3 |
| LTRP5 | DOMAIN_30173 | 7.165 | 33.900 | 0.794 | 3 |
| LTRP5 | DOMAIN_26749 | 7.165 | 40.467 | 0.945 | 3 |
| LTRP5 | DOMAIN_27385 | 7.165 | 35.933 | 0.473 | 3 |
| CasX 491 | N/A | 7.37 | 76.167 | 0.808 | 3 |

TABLE 62

Levels of B2M repression mediated by dXR and LTRP constructs with various repressor domains quantified at 13 days post-transfection.

| Construct | Repressor domain | Spacer | Mean % HLA-negative cells | Standard deviation | Sample size |
|---|---|---|---|---|---|
| dXR | ZIM3 | 7.165 | 7.258 | 14.130 | 6 |
| dXR | ZIM3 | NT | 1.218 | 0.144 | 6 |
| LTRP5 | ZIM3 | NT | 1.712 | 0.328 | 6 |
| LTRP5 | DOMAIN_31643 | 7.165 | 6.800 | 0.786 | 3 |
| LTRP5 | DOMAIN_19460 | 7.165 | 9.690 | 0.147 | 3 |
| LTRP5 | DOMAIN_26732 | 7.165 | 10.800 | 0.173 | 3 |
| LTRP5 | DOMAIN_18563 | 7.165 | 12.100 | 1.587 | 3 |
| LTRP5 | DOMAIN_19892 | 7.165 | 12.900 | 0.458 | 3 |
| LTRP5 | DOMAIN_21317 | 7.165 | 13.967 | 0.513 | 3 |
| LTRP5 | DOMAIN_9114 | 7.165 | 13.767 | 1.504 | 3 |
| LTRP5 | DOMAIN_10277 | 7.165 | 15.333 | 1.150 | 3 |
| LTRP5 | DOMAIN_27060 | 7.165 | 13.867 | 1.457 | 3 |
| LTRP5 | DOMAIN_12452 | 7.165 | 15.700 | 1.562 | 3 |
| LTRP5 | DOMAIN_21336 | 7.165 | 14.267 | 0.651 | 3 |
| LTRP5 | DOMAIN_30661 | 7.165 | 14.933 | 1.537 | 3 |
| LTRP5 | DOMAIN_12292 | 7.165 | 17.967 | 0.666 | 3 |
| LTRP5 | DOMAIN_8853 | 7.165 | 18.600 | 0.361 | 3 |
| LTRP5 | DOMAIN_9538 | 7.165 | 18.733 | 1.102 | 3 |
| LTRP5 | DOMAIN_19821 | 7.165 | 15.867 | 2.237 | 3 |
| LTRP5 | ZIM3 | 7.165 | 18.267 | 3.578 | 6 |
| LTRP5 | DOMAIN_26070 | 7.165 | 18.233 | 1.960 | 3 |
| LTRP5 | DOMAIN_19476 | 7.165 | 20.100 | 1.323 | 3 |
| LTRP5 | DOMAIN_4687 | 7.165 | 19.767 | 0.961 | 3 |
| LTRP5 | DOMAIN_25405 | 7.165 | 22.100 | 1.609 | 3 |
| LTRP5 | DOMAIN_10577 | 7.165 | 21.133 | 1.266 | 3 |
| LTRP5 | DOMAIN_2942 | 7.165 | 21.633 | 2.101 | 3 |
| LTRP5 | DOMAIN_27604 | 7.165 | 24.700 | 2.364 | 3 |
| LTRP5 | DOMAIN_7694 | 7.165 | 26.900 | 0.436 | 3 |
| LTRP5 | DOMAIN_29304 | 7.165 | 25.367 | 0.462 | 3 |
| LTRP5 | DOMAIN_9331 | 7.165 | 27.133 | 0.681 | 3 |
| LTRP5 | DOMAIN_30173 | 7.165 | 25.400 | 0.656 | 3 |
| LTRP5 | DOMAIN_26749 | 7.165 | 27.700 | 0.608 | 3 |
| LTRP5 | DOMAIN_27385 | 7.165 | 27.733 | 0.808 | 3 |
| CasX 491 | N/A | 7.37 | 81.167 | 0.945 | 3 |

TABLE 63

Levels of B2M repression mediated by dXR and LTRP constructs with various repressor domains quantified at 20 days post-transfection.

| Construct | Repressor domain | Spacer | Mean % HLA-negative cells | Standard deviation | Sample size |
|---|---|---|---|---|---|
| dXR | ZIM3 | 7.165 | 1.120 | 0.345 | 6 |
| dXR | ZIM3 | NT | 1.425 | 1.093 | 6 |
| LTRP5 | ZIM3 | NT | 2.412 | 2.055 | 6 |
| LTRP5 | DOMAIN_31643 | 7.165 | 6.147 | 1.909 | 3 |
| LTRP5 | DOMAIN_19460 | 7.165 | 8.290 | 0.460 | 3 |
| LTRP5 | DOMAIN_26732 | 7.165 | 7.950 | 1.171 | 3 |
| LTRP5 | DOMAIN_18563 | 7.165 | 10.163 | 1.163 | 3 |
| LTRP5 | DOMAIN_19892 | 7.165 | 11.800 | 1.249 | 3 |
| LTRP5 | DOMAIN_21317 | 7.165 | 12.833 | 2.581 | 3 |
| LTRP5 | DOMAIN_9114 | 7.165 | 12.467 | 0.681 | 3 |
| LTRP5 | DOMAIN_10277 | 7.165 | 13.633 | 0.635 | 3 |
| LTRP5 | DOMAIN_27060 | 7.165 | 12.400 | 1.375 | 3 |
| LTRP5 | DOMAIN_12452 | 7.165 | 13.233 | 0.451 | 3 |
| LTRP5 | DOMAIN_21336 | 7.165 | 12.733 | 0.503 | 3 |
| LTRP5 | DOMAIN_30661 | 7.165 | 13.633 | 0.379 | 3 |
| LTRP5 | DOMAIN_12292 | 7.165 | 14.300 | 0.100 | 3 |
| LTRP5 | DOMAIN_8853 | 7.165 | 16.200 | 2.524 | 3 |
| LTRP5 | DOMAIN_9538 | 7.165 | 16.200 | 1.100 | 3 |
| LTRP5 | DOMAIN_19821 | 7.165 | 14.233 | 1.790 | 3 |
| LTRP5 | ZIM3 | 7.165 | 17.033 | 4.457 | 6 |
| LTRP5 | DOMAIN_26070 | 7.165 | 16.467 | 1.401 | 3 |
| LTRP5 | DOMAIN_19476 | 7.165 | 17.133 | 0.569 | 3 |
| LTRP5 | DOMAIN_4687 | 7.165 | 16.700 | 0.755 | 3 |
| LTRP5 | DOMAIN_25405 | 7.165 | 19.300 | 1.114 | 3 |
| LTRP5 | DOMAIN_10577 | 7.165 | 18.167 | 0.551 | 3 |
| LTRP5 | DOMAIN_2942 | 7.165 | 18.567 | 2.001 | 3 |
| LTRP5 | DOMAIN_27604 | 7.165 | 21.533 | 1.850 | 3 |
| LTRP5 | DOMAIN_7694 | 7.165 | 22.467 | 0.709 | 3 |
| LTRP5 | DOMAIN_29304 | 7.165 | 22.033 | 1.365 | 3 |
| LTRP5 | DOMAIN_9331 | 7.165 | 22.800 | 1.510 | 3 |
| LTRP5 | DOMAIN_30173 | 7.165 | 24.800 | 3.936 | 3 |
| LTRP5 | DOMAIN_26749 | 7.165 | 24.633 | 1.290 | 3 |
| LTRP5 | DOMAIN_27385 | 7.165 | 23.633 | 1.935 | 3 |
| CasX 491 | N/A | 7.37 | 83.633 | 3.443 | 3 |

TABLE 64

Levels of B2M repression mediated by dXR and LTRP constructs with various repressor domains quantified at 27 days post-transfection.

| Construct | Repressor domain | Spacer | Mean % HLA-negative cells | Standard deviation | Sample size |
|---|---|---|---|---|---|
| dXR | ZIM3 | 7.165 | 1.845 | 1.522 | 6 |
| dXR | ZIM3 | NT | 2.463 | 2.385 | 6 |
| LTRP5 | ZIM3 | NT | 3.022 | 2.959 | 6 |
| LTRP5 | DOMAIN_31643 | 7.165 | 3.687 | 0.562 | 3 |
| LTRP5 | DOMAIN_19460 | 7.165 | 5.853 | 0.416 | 3 |
| LTRP5 | DOMAIN_26732 | 7.165 | 6.647 | 0.985 | 3 |
| LTRP5 | DOMAIN_18563 | 7.165 | 7.660 | 0.939 | 3 |
| LTRP5 | DOMAIN_19892 | 7.165 | 8.920 | 0.596 | 3 |
| LTRP5 | DOMAIN_21317 | 7.165 | 9.640 | 0.487 | 3 |
| LTRP5 | DOMAIN_9114 | 7.165 | 10.167 | 2.191 | 3 |
| LTRP5 | DOMAIN_10277 | 7.165 | 10.237 | 0.446 | 3 |
| LTRP5 | DOMAIN_27060 | 7.165 | 10.377 | 1.046 | 3 |
| LTRP5 | DOMAIN_12452 | 7.165 | 10.473 | 0.654 | 3 |
| LTRP5 | DOMAIN_21336 | 7.165 | 10.767 | 0.404 | 3 |
| LTRP5 | DOMAIN_30661 | 7.165 | 11.133 | 1.790 | 3 |
| LTRP5 | DOMAIN_12292 | 7.165 | 11.833 | 0.252 | 3 |
| LTRP5 | DOMAIN_8853 | 7.165 | 11.967 | 1.401 | 3 |
| LTRP5 | DOMAIN_9538 | 7.165 | 12.100 | 1.000 | 3 |
| LTRP5 | DOMAIN_19821 | 7.165 | 12.200 | 1.868 | 3 |
| LTRP5 | ZIM3 | 7.165 | 12.483 | 2.585 | 6 |
| LTRP5 | DOMAIN_26070 | 7.165 | 13.533 | 2.401 | 3 |
| LTRP5 | DOMAIN_19476 | 7.165 | 13.900 | 1.153 | 3 |

TABLE 64-continued

Levels of B2M repression mediated by dXR and LTRP constructs with various repressor domains quantified at 27 days post-transfection.

| Construct | Repressor domain | Spacer | Mean % HLA-negative cells | Standard deviation | Sample size |
|---|---|---|---|---|---|
| LTRP5 | DOMAIN_4687 | 7.165 | 13.900 | 1.970 | 3 |
| LTRP5 | DOMAIN_25405 | 7.165 | 14.467 | 1.387 | 3 |
| LTRP5 | DOMAIN_10577 | 7.165 | 15.233 | 1.301 | 3 |
| LTRP5 | DOMAIN_2942 | 7.165 | 15.433 | 2.255 | 3 |
| LTRP5 | DOMAIN_27604 | 7.165 | 18.600 | 2.307 | 3 |
| LTRP5 | DOMAIN_7694 | 7.165 | 19.067 | 1.021 | 3 |
| LTRP5 | DOMAIN_29304 | 7.165 | 19.167 | 1.935 | 3 |
| LTRP5 | DOMAIN_9331 | 7.165 | 19.333 | 0.808 | 3 |
| LTRP5 | DOMAIN_30173 | 7.165 | 20.133 | 0.764 | 3 |
| LTRP5 | DOMAIN_26749 | 7.165 | 20.467 | 0.493 | 3 |
| LTRP5 | DOMAIN_27385 | 7.165 | 21.000 | 1.411 | 3 |
| CasX 491 | N/A | 7.37 | 80.933 | 0.451 | 3 |

As shown in Tables 57-64, treatment with most LTRP5 constructs containing an enhanced repressor domain, paired with a gRNA containing spacer 7.165, resulted in higher levels of B2M repression in comparison to the level of repression achieved with use of an LTRP5-ZIM3 construct. The data from these experiments were used to identify the top 9 candidate repressor domains using the following criteria. First, demonstration of at least a 20% increase in mean repressive activity as measured by B2M knockdown over the mean repressive activity exhibited by the LTRP5-ZIM3 control at all four timepoints in the experiments above, which resulted in the selection of three repressor domains. To identify more candidate repressor domains, domains that exhibited at least a 20% increase in mean activity over that exhibited by the LTRP5-ZIM3 control in at least two timepoints, prioritizing later timepoints; and, third, selecting the best performing domains from each of the 75 clusters (discussed in Example 17) to maintain diversity of amino acid sequences or eliminating domains with >90% sequence identity to previously identified human repressor domains (Tycko, J. et al., High-Throughput Discovery and Characterization of Human Transcriptional Effectors *Cell.* 183(7):2020-2035 (2020)). The nine most effective repressor domains identified were DOMAIN_7694, DOMAIN_10123, DOMAIN_15507, DOMAIN_17905, DOMAIN_20505, DOMAIN_26749, DOMAIN_27604, DOMAIN_29304, and DOMAIN_30173, and their sequences are listed in Table 65.

TABLE 65

List of top 9 and top 95 most effective repressor domains.

| Domain ID | Description | SEQ ID NO |
|---|---|---|
| Top 9 repressor domains | | |
| DOMAIN_7694 | Columba livia repressor domain | 130 |
| DOMAIN_10123 | Rattus norvegicus repressor domain | 131 |
| DOMAIN_15507 | Cebus imitator repressor domain | 132 |
| DOMAIN_17905 | Chimp repressor domain | 133 |
| DOMAIN_20505 | Chlorocebus sabaeus repressor domain | 134 |
| DOMAIN_26749 | Ophiophagus hannah repressor domain | 135 |
| DOMAIN_27604 | Ailuropoda melanoleuca repressor domain | 136 |
| DOMAIN_29304 | Peromyscus maniculatus bairdii repressor domain | 137 |
| DOMAIN_30173 | Phyllostomus discolor repressor domain | 138 |
| Remaining repressor domains in the top 95 repressor domains | | |
| DOMAIN_737 | Bonobo repressor domain | 139 |
| DOMAIN_10331 | Colobus angolensis palliatus repressor domain | 140 |
| DOMAIN_10948 | Colobus angolensis palliatus repressor domain | 141 |
| DOMAIN_11029 | Mandrillus leucophaeus repressor domain | 142 |
| DOMAIN_17358 | Bos indicus × Bos taurus repressor domain | 143 |
| DOMAIN_17759 | Felis catus repressor domain | 144 |
| DOMAIN_18258 | Physeter macrocephalus repressor domain | 145 |
| DOMAIN_19804 | Callorhinus ursinus repressor domain | 146 |
| DOMAIN_221 | Bonobo repressor domain | 147 |
| DOMAIN_881 | Bonobo repressor domain | 148 |
| DOMAIN_2380 | Orangutan repressor domain | 149 |
| DOMAIN_2942 | Gibbon repressor domain | 150 |
| DOMAIN_4687 | Marmoset repressor domain | 151 |
| DOMAIN_4806 | Marmoset repressor domain | 152 |
| DOMAIN_4968 | Marmoset repressor domain | 153 |
| DOMAIN_5066 | Marmoset repressor domain | 154 |
| DOMAIN_5290 | Owl Monkey repressor domain | 155 |
| DOMAIN_5463 | Owl Monkey repressor domain | 156 |
| DOMAIN_6248 | Saimiri boliviensis boliviensis repressor domain | 157 |
| DOMAIN_6445 | Alligator sinensis repressor domain | 158 |
| DOMAIN_6802 | Pantherophis guttatus repressor domain | 159 |
| DOMAIN_6807 | Xenopus laevis repressor domain | 160 |
| DOMAIN_7255 | Microcaecilia unicolor repressor domain | 161 |
| DOMAIN_8503 | Mus caroli repressor domain | 162 |
| DOMAIN_8790 | Marmota monax repressor domain | 163 |
| DOMAIN_8853 | Mesocricetus auratus repressor domain | 164 |
| DOMAIN_9114 | Peromyscus maniculatus bairdii repressor domain | 165 |
| DOMAIN_9331 | Peromyscus maniculatus bairdii repressor domain | 166 |
| DOMAIN_9538 | Mus musculus repressor domain | 167 |
| DOMAIN_9960 | Octodon degus repressor domain | 168 |
| DOMAIN_10277 | Dipodomys ordii repressor domain | 169 |
| DOMAIN_10577 | Colobus angolensis palliatus repressor domain | 170 |

TABLE 65-continued

| List of top 9 and top 95 most effective repressor domains. | | |
|---|---|---|
| Domain ID | Description | SEQ ID NO |
| DOMAIN_11348 | Chlorocebus sabaeus repressor domain | 171 |
| DOMAIN_11386 | Capra hircus repressor domain | 172 |
| DOMAIN_11486 | Bos mutus repressor domain | 173 |
| DOMAIN_11683 | Nomascus leucogenys repressor domain | 174 |
| DOMAIN_12292 | Sus scrofa repressor domain | 175 |
| DOMAIN_12452 | Neophocaena asiaeorientalis asiaeorientalis repressor domain | 176 |
| DOMAIN_12631 | Macaca fascicularis repressor domain | 177 |
| DOMAIN_13331 | Macaca fascicularis repressor domain | 178 |
| DOMAIN_13468 | Phascolarctos cinereus repressor domain | 179 |
| DOMAIN_13539 | Gorilla repressor domain | 180 |
| DOMAIN_14659 | Acinonyx jubatus repressor domain | 181 |
| DOMAIN_14755 | Cebus imitator repressor domain | 182 |
| DOMAIN_15126 | Callithrix jacchus repressor domain | 183 |
| DOMAIN_16444 | Acinonyx jubatus repressor domain | 184 |
| DOMAIN_16688 | Lipotes vexillifer repressor domain | 185 |
| DOMAIN_16806 | Sapajus apella repressor domain | 186 |
| DOMAIN_17317 | Otolemur garnettii repressor domain | 187 |
| DOMAIN_17432 | Otolemur garnettii repressor domain | 188 |
| DOMAIN_18137 | Monodelphis domestica repressor domain | 189 |
| DOMAIN_18216 | Physeter macrocephalus repressor domain | 190 |
| DOMAIN_18563 | OwlMonkey repressor domain | 191 |
| DOMAIN_19229 | Enhydra lutris kenyoni repressor domain | 192 |
| DOMAIN_19460 | Monodelphis domestica repressor domain | 193 |
| DOMAIN_19476 | OwlMonkey repressor domain | 194 |
| DOMAIN_19821 | Rhinopithecus roxellana repressor domain | 195 |
| DOMAIN_19892 | Ursus maritimus repressor domain | 196 |
| DOMAIN_19896 | Ovis aries repressor domain | 197 |
| DOMAIN_19949 | Callorhinus ursinus repressor domain | 198 |
| DOMAIN_21247 | Neovison vison repressor domain | 199 |
| DOMAIN_21317 | Pteropus vampyrus repressor domain | 200 |
| DOMAIN_21336 | Equus caballus repressor domain | 201 |
| DOMAIN_21603 | Lipotes vexillifer repressor domain | 202 |
| DOMAIN_21755 | Equus caballus repressor domain | 203 |
| DOMAIN_22153 | Zalophus californianus repressor domain | 204 |
| DOMAIN_22270 | Bonobo repressor domain | 205 |
| DOMAIN_23394 | Vicugna pacos repressor domain | 206 |
| DOMAIN_23723 | Carlito syrichta repressor domain | 207 |
| DOMAIN_24125 | Saimiri boliviensis boliviensis repressor domain | 208 |
| DOMAIN_24458 | Lynx pardinus repressor domain | 209 |
| DOMAIN_24663 | Myotis brandtii repressor domain | 210 |
| DOMAIN_25289 | Ursus maritimus repressor domain | 211 |
| DOMAIN_25379 | Sapajus apella repressor domain | 212 |
| DOMAIN_25405 | Desmodus rotundus repressor domain | 213 |
| DOMAIN_26070 | Geotrypetes seraphini repressor domain | 214 |
| DOMAIN_26322 | Geotrypetes seraphini repressor domain | 215 |
| DOMAIN_26732 | Meleagris gallopavo repressor domain | 216 |
| DOMAIN_27060 | Gopherus agassizii repressor domain | 217 |
| DOMAIN_27385 | Octodon degus repressor domain | 218 |
| DOMAIN_27506 | Bos mutus repressor domain | 219 |
| DOMAIN_27811 | Callithrix jacchus repressor domain | 220 |
| DOMAIN_28640 | Colinus virginianus repressor domain | 221 |
| DOMAIN_28803 | Monodelphis domestica repressor domain | 222 |
| DOMAIN_30661 | Physeter macrocephalus repressor domain | 223 |
| DOMAIN_31643 | Micrurus lemniscatus lemniscatus repressor domain | 224 |

Accordingly, the experiments described herein demonstrate that the use of the enhanced repressor domains identified in Example 17 resulted in improved levels of transcriptional repression in the context of an LTRP construct.

Example 19: Identification of Alternative Consensus Protein Sequence Motifs of Enhanced Repressor Domains In the previous Example 17, nine protein sequence motifs (FIGS. 57A-57I) were generated for the top 1597 enhanced repressor domains using the following methods: 1) comparing the amino acid sequences of the top 1597 repressor domains to a negative training set of 1506 repressor domains with p-values less than 0.01 and log 2 (fold change) values less than 0, and 2), and comparing the amino acid sequences of the top 1597 domains to shuffled sequences derived from the 1597 sequences. In this example, five more alternative consensus protein sequence motifs were generated by comparing the amino acid sequences of the top 1597 repressors domains to a negative training set containing the amino acid sequences of human ZIM3 (SEQ ID NO: 128) and ZNF10 KRAB domains (SEQ ID NO: 129). Logos of these resulting five motifs are provided in FIGS. 58A-58E. Table 66, below, provides the unadjusted p-value and number and percentage of sequences matching the motif in the top 1597 novel repressor domains for each of the five alternative motifs, as calculated by STREME. Table 67 provides the sequences of each motif, showing the amino acid residues present at each position within the motifs (from N- to C-terminus).

TABLE 66

Characteristics of alternative consensus protein sequence motifs of top 1597 enhanced repressor domains generated when compared to a negative training set containing ZIM3 and ZNF10.

| Alternative Motif ID | Unadjusted P-value | Number and percentage of sites matching motif in 1597 enhanced domains |
|---|---|---|
| 1 | 1.7E−001 | 1432 (89.7%) |
| 2 | 2.1E−001 | 1236 (77.4%) |
| 3 | 2.7E−001 | 1058 (66.2%) |
| 4 | 4.2E−001 | 1554 (97.3%) |
| 5 | 4.3E−001 | 679 (42.5%) |

TABLE 67

Characteristics of alternative consensus protein sequence motifs of 1597 enhanced repressor domains.

| Motif ID | Position in motif | Amino acid residues with >5% representation in motif |
|---|---|---|
| 1 (SEQ ID NO: 2945) | 1 | D |
| | 2 | V |
| | 3 | A |
| | 4 | V |
| | 5 | Y |
| | 6 | F |
| | 7 | S |
| | 8 | P |
| | 9 | E |
| | 10 | E |
| | 11 | W |
| | 12 | G |
| | 13 | C |
| | 14 | L |
| 2 | 1 | A, D, G, N, R, S |
| | 2 | P, S, T |
| | 3 | A, S, T |
| | 4 | Q |
| | 5 | K, R |
| | 6 | A, D, K, N, S, T |
| | 7 | L |
| | 8 | Y |
| 3 | 1 | A, P, S |
| | 2 | K |
| | 3 | P |
| | 4 | A, D, E |
| | 5 | L, M, V |
| | 6 | I, V |
| | 7 | F, S, T |
| | 8 | H, K L, Q, R, W |
| 4 | 1 | L |
| | 2 | E |
| | 3 | E, K, Q, R |
| | 4 | E, G, R |
| | 5 | A, D, E, K |
| | 6 | A, D, E |
| | 7 | L, P |
| | 8 | C, W |
| 5 (SEQ ID NO: 2946) | 1 | D, E |
| | 2 | V |
| | 3 | M |
| | 4 | L |
| | 5 | E |
| | 6 | N, T |
| | 7 | Y |
| | 8 | A, E, G, Q, R, S |
| | 9 | H, N |
| | 10 | L, M, V |
| | 11 | A, L, V |
| | 12 | S |
| | 13 | L, V |
| | 14 | A, G, V |
| | 15 | C, F, L |

The methods used as described in this example resulted in the generation of alternative motifs associated with the 1597 repressor domains that were identified as the strongest transcriptional repressors in Example 17. Notably, alternative motifs 1, 2, 3, and 5 were not found in either ZIM3 or ZNF10, and instead were uniquely found in the majority of the 1597 top repressor domains. Furthermore, every amino acid position of alternative motif 1 appeared to be highly conserved and was found in nearly 90% of the 1597 domains; this sequence is believed to be important in mediating the recruitment of Trim28 and downstream factors involved in transcriptional and epigenetic repression. As for the other alternative consensus motifs identified, these motifs may represent additional and novel mechanisms of repression that are specific to certain clusters of repressor domains.

Example 20: Demonstration that Silencing of a Target Locus Mediated by LTRP Molecules is Reversible Using a DNMT1 Inhibitor Experiments were performed to demonstrate that durable repression of a target locus mediated by LTRP molecules is reversible, such that treatment with a DNMT1 inhibitor would remove methyl marks to reactivate expression of the target gene.

Materials and Methods

LTRP #5 containing the ZIM3-KRAB domain, which was generated as described in Example 13, and CasX variant 491 were used in this experiment. A B2M-targeting gRNA with scaffold 174 containing spacer 7.37 (SEQ ID NO: 3137) or a non-targeting gRNA containing spacer 0.0 (SEQ ID NO: 3232) were used in this experiment.

Transfection of HEK293T Cells:

HEK293T cells were transfected with 100 ng of a plasmid containing a construct encoding for either CasX 491 or LTRP #5 containing the ZIM3-KRAB domain with a B2M-targeting gRNA or non-targeting gRNA and cultured for 58 days. These transfected HEK293T cells were subsequently re-seeded at ~30,000 cells well of a 96-well plate and were treated with 5-aza-2'-deoxycytidine (5-azadC), a DNMT1 inhibitor, at concentrations ranging from 0 μM to 20 μM. Six days post-treatment with 5-azadC, cells were harvested for B2M silencing analysis at day 5, day 12, and day 21 post-transfection. Briefly, repression analysis was conducted by analyzing B2M protein expression via HLA immunostaining followed by flow cytometry, as described in Example 13. Treatments for each dose of 5-azadC for each experimental condition were performed in triplicates. Results:

The plot in FIG. 59 shows the percentage of transfected HEK293T cells treated with the indicated concentrations of 5-azadC that expressed the B2M protein. The data demonstrate that 5-azadC treatment of cells transfected with a plasmid encoding LTRP5-ZIM3 with the B2M-targeting gRNA resulted in a reactivation of the B2M gene (FIG. 59). Specifically, ~75% of treated cells exhibited B2M expression with 20u M 5-azadC, compared to the 25% of cells with B2M expression at Ou M concentration (FIG. 59). Furthermore, 5-azadC treatment of cells transfected with a plasmid encoding CasX 491 with the B2M-targeting gRNA did not exhibit reactivation of the B2M gene. FIG. 60 is a plot that juxtaposes B2M repression activity with gene reactivation upon 5-azadC treatment. The data show B2M repression post-transfection with either CasX 491 or LTRP5-ZIM3 with the B2M-targeting gRNA, resulting in ~75% repression of B2M expression by day 58; however, B2M expression is increased upon 5-azadC treatment (FIG. 60). As anticipated, 5-azadC treatment of cells transfected with either CasX 491 or LTRP5-ZIM3 with the non-targeting gRNA did not demonstrate repression or reactivation (FIGS. 59-60).

The experiments demonstrate reversibility of LTRP-mediated repression of a target locus. By using a DNMT1 inhibitor to remove methyl marks implemented by LTRP molecules, the silenced target gene was reactivated to induce expression of the target protein.

Example 21: Exemplary Sequences of LTRP Fusion Proteins

Table 68 provides exemplary full-length LTRP fusion proteins in configurations 1, 4, or 5 with the ADD domain (FIG. 2), with human ZIM3 or ZNF10 KRAB domains or one of the top nine most effective repressor domains: DOMAIN_7694, DOMAIN_10123, DOMAIN_15507, DOMAIN_17905, DOMAIN_20505, DOMAIN_26749, DOMAIN_27604, DOMAIN_29304, and DOMAIN_30173. In Table 68, the components are listed in order from N- to C-terminus.

TABLE 68

Exemplary protein sequences of LTRP fusion proteins

| LTRP # | Components | Domains | Amino acid sequence SEQ ID NO |
|---|---|---|---|
| LTRP1 with ADD domain | START codon + NLS + buffer sequence | | 3269 |
| | START codon + DNMT3A ADD domain | | 3270 |
| | DNMT3A catalytic domain | | 126 |
| | Linker (L2) | | 122 |
| | DNMT3L interaction domain | | 127 |
| | Linker (L1) | | 123 |
| | Linker (L3A) + buffer | | 3271 |
| | dCasX491 | | 4 |
| | Buffer + linker (L3B) | | 3272 |
| | Repressor domain 1 | Human ZIM3 | 3240 |
| | | Human ZNF10 | 3239 |
| | | *Columba livia* repressor domain (DOMAIN_7694) | 130 |
| | | *Rattus norvegicus* repressor domain (DOMAIN_10123) | 131 |
| | | *Cebus imitator* repressor domain (DOMAIN_15507) | 132 |
| | | Chimpanzee repressor domain (DOMAIN_17905) | 133 |
| | | *Chlorocebus sabaeus* repressor domain (DOMAIN_20505) | 134 |
| | | *Ophiophagus hannah* repressor domain (DOMAIN_26749) | 135 |
| | | *Ailuropoda melanoleuca* repressor domain (DOMAIN_27604) | 136 |
| | | *Peromyscus maniculatus bairdii* repressor domain (DOMAIN_29304) | 137 |
| | | *Phyllostomus discolor* repressor domain (DOMAIN_30173) | 138 |
| | Buffer + NLS | | 3273 |
| LTRP4 with ADD domain | START codon + NLS + buffer sequence | | 3269 |
| | Repressor domain 1 | Human ZIM3 | 3240 |
| | | Human ZNF10 | 3239 |
| | | *Columba livia* repressor domain (DOMAIN_7694) | 130 |
| | | *Rattus norvegicus* repressor domain (DOMAIN_10123) | 131 |
| | | *Cebus imitator* repressor domain (DOMAIN_15507) | 132 |
| | | Chimpanzee repressor domain (DOMAIN_17905) | 133 |
| | | *Chlorocebus sabaeus* repressor domain (DOMAIN_20505) | 134 |
| | | *Ophiophagus hannah* repressor domain (DOMAIN_26749) | 135 |
| | | *Ailuropoda melanoleuca* repressor domain (DOMAIN_27604) | 136 |
| | | *Peromyscus maniculatus* | 137 |

TABLE 68-continued

Exemplary protein sequences of LTRP fusion proteins

| LTRP # | Components | Domains | Amino acid sequence SEQ ID NO |
|---|---|---|---|
| | | *bairdii* repressor domain (DOMAIN_29304) | |
| | | *Phyllostomus discolor* repressor domain (DOMAIN_30173) | 138 |
| | Linker (L3A) + buffer | | 3271 |
| | START codon + DNMT3A ADD domain | | 3270 |
| | DNMT3A catalytic domain | | 126 |
| | Linker (L2) | | 122 |
| | DNMT3L interaction domain | | 127 |
| | Linker (L1) | | 123 |
| | dCasX491 | | 4 |
| | Buffer + linker (L3B) | | 3272 |
| | NLS | | 30 |
| LTRP5 with ADD domain | START codon + NLS + buffer sequence | | 3269 |
| | START codon + DNMT3A ADD domain | | 3270 |
| | DNMT3A catalytic domain | | 126 |
| | Linker (L2) | | 122 |
| | DNMT3L interaction domain | | 127 |
| | Linker (L3A) | | 124 |
| | Repressor domain 1 | Human ZIM3 | 3240 |
| | | Human ZNF10 | 3239 |
| | | *Columba livia* repressor domain (DOMAIN_7694) | 130 |
| | | *Rattus norvegicus* repressor domain (DOMAIN_10123) | 131 |
| | | *Cebus imitator* repressor domain (DOMAIN_15507) | 132 |
| | | Chimpanzee repressor domain (DOMAIN_17905) | 133 |
| | | *Chlorocebus sabaeus* repressor domain (DOMAIN_20505) | 134 |
| | | *Ophiophagus hannah* repressor domain (DOMAIN_26749) | 135 |
| | | *Ailuropoda melanoleuca* repressor domain (DOMAIN_27604) | 136 |
| | | *Peromyscus maniculatus bairdii* repressor domain (DOMAIN_29304) | 137 |
| | | *Phyllostomus discolor* repressor domain (DOMAIN_30173) | 138 |
| | Linker (L1) | | 123 |
| | dCasX491 | | 4 |
| | Buffer + linker (L3B) | | 3272 |
| | NLS | | 30 |

Table 69 provides exemplary amino acid sequences of components of LTRP constructs. In Table 69, the protein domains are shown without starting methionines.

TABLE 69

Exemplary protein sequences of components of LTRP constructs.

| Component | Amino acid sequence SEQ ID NO |
|---|---|
| DNMT3A catalytic domain (CD) | 126 |
| DNMT3L interaction domain | 127 |
| dCasX491 | 4 |
| Linker 1 (L1) | 123 |

TABLE 69-continued

Exemplary protein sequences of components of LTRP constructs.

| Component | Amino acid sequence SEQ ID NO |
|---|---|
| Linker 2 (L2) | 122 |
| Linker 3A (L3A) | 124 |
| Linker 3B (L3B) | 120 |
| NLS | 30 |
| DNMT3A ADD domain | 125 |

Example 22: A Preliminary Evaluation of Genome-Wide Transcriptomic Effects of Using an LTRP Molecule and a PCSK9-Targeting gRNA to Repress the PCSK9 Locus to Decrease PCSK9 Secretion In Vitro Experiments were performed to determine the effects of using an LTRP molecule with a targeting gRNA to repress the PCSK9 locus and reduce PCSK9 secretion levels in human cells. Specifically, genome-wide transcriptomic effects were evaluated to determine the extent of off-target effects of treating the cells with LTRP5-ADD-ZIM3 and select PCSK9-targeting spacers.

Materials and Methods

Transfection of Human Huh7 Cells:

mRNA encoding the following molecules were generated by IVT using similar methods as described in Example 2:1) a catalytically-active CasX 676 (as described in Example 5), 2) dXR1 (as described in Example 2), and 3) LTRP5-ADD-ZIM3 (as described in Example 2). The DNA and mRNA sequences for CasX 676 are shown in Tables 21 and 22; the DNA and mRNA sequences for dXR1 are shown in Tables 11 and 12; the DNA and mRNA sequences for LTRP5-ADD-ZIM3 are shown in Tables 18 and 19.

gRNAs containing select NHP-conserved spacers targeting the PCSK9 locus were designed using gRNA scaffold 316 and chemically synthesized with the v1 modification profile (as described in Example 7). These NHP-conserved spacers, which were selected given their efficacy in sustaining PCSK9 repression through at least day 36 as demonstrated in Example 3, were TG-06-154, TG-06-167, TG-06-133, TG-06-146, and TG-06-352, TG-06-138 (see Table 17 for SEQ ID NOS) was used to pair with dXR1 as well as LTRP5-ADD-ZIM3, and spacer TG-06-001 (also known as spacer 6.1; SEQ ID NO: 1834) was used to pair with CasX 676. A non-targeting spacer was used as an experimental control.

Seeded Huh7 cells were transfected with mRNA encoding a catalytically-active CasX 676, dXR1, or LTRP5-ADD-ZIM3 and a gRNA with scaffold 316 and a spacer targeting the PCSK9 locus. Cells were harvested at 6 and 26 days post-transfection and subsequently lysed and stored in DNA/RNA Shield (Zymo Research). As an additional control, untreated, naïve cells were also harvested. The collected samples were subjected to gDNA/RNA extraction using the Quick-DNA/RNA Miniprep Plus kit (Zymo Research). RNA samples were used for total RNA sequencing (RNA-seq), which was performed by a third-party. Raw FASTQ files were received and processed with FASTQC, and adapters were trimmed using Trim Galore. Transcript expression was then quantified against the hg38 genome using Salmon to generate normalized counts for each gene (transcripts per million, or TPM). Differential expression analysis was performed using DESeq2. Genes with fewer than 10 counts in all samples were omitted from analysis, and all pairwise comparisons (e.g., differential gene expression analyses between untreated and treated conditions at the two individual timepoints) were done with significance thresholds of $|\log 2FC|>2$ and adjusted p-value<0.001.

Results

Huh7 cells were transfected with mRNA encoding CasX 676, dXR1 or LTRP5-ADD-ZIM3 with a PCSK9-targeting gRNA and harvested at the 6 and 26 days post-transfection for RNA-seq analysis. Quantification of normalized PCSK9 read counts was determined for each experimental condition, and log 2 fold changes in normalized PCSK9 transcript counts comparing each experimental condition and the untreated, naïve condition were calculated (Table 70). RNA-seq analyses revealed that use of spacers TG-06-154, TG-06-167, and TG-06-133, when paired with LTRP5-ADD-ZIM3, durably repress PCSK9 expression through day 26 (Table 70). Furthermore, while use of the non-targeting spacer with LTRP5-ADD-ZIM3 appeared to reduce PCSK9 expression, this level of repression was not as high compared to the repression levels achieved with spacers TG-06-154, TG-06-167, and TG-06-133. As anticipated, use of spacer TG-06-138 with dXR1 resulted in transient silencing of the PCSK9 locus, although unexpectedly, PCSK9 down-regulation was attenuated by day 26 when using spacer 6.1 paired with CasX 676 (Table 70).

TABLE 70

Log2FC of normalized PCSK9 read counts for each indicated experimental condition compared to untreated, naïve condition.

| Molecule | Spacer | Log2FC of PCSK9 read counts - Day 6 | Log2FC of PCSK9 read counts - Day 26 |
|---|---|---|---|
| CasX 676 | NT | 0.022 | −0.001 |
| CasX 676 | 6.1 | −1.826 | −0.818 |
| dXR1 | NT | 0.016 | 0.068 |
| dXR1 | TG-06-138 | −4.291 | −0.266 |
| LTRP5-ADD-ZIM3 | NT | −0.700 | −1.094 |
| LTRP5-ADD-ZIM3 | TG-06-138 | −4.254 | −1.861 |
| LTRP5-ADD-ZIM3 | TG-06-154 | −5.202 | −4.283 |
| LTRP5-ADD-ZIM3 | TG-06-167 | −3.404 | −2.856 |
| LTRP5-ADD-ZIM3 | TG-06-133 | −3.342 | −2.773 |
| LTRP5-ADD-ZIM3 | TG-06-146 | −3.709 | −1.755 |
| LTRP5-ADD-ZIM3 | TG-06-352 | −3.330 | −1.981 |

Differential gene expression analyses were performed by comparing each experimental condition to the untreated, naïve control to determine the number of upregulated and downregulated genes detected at 6 days and 26 days after treatment. Quantification of differentially expressed genes is shown in Table 71. Representative volcano plots illustrating the differential gene expression analyses for LTRP5-ADD-ZIM3 with the non-targeting spacer, LTRP5-ADD-ZIM3 with spacer TG-06-154, and LTRP5-ADD-ZIM3 with spacer TG-06-133 are shown in FIGS. 65A-65B, 66A-66B, and 67A-67B respectively. TG-06-154, TG-06-133, and TG-06-167 were selected based on their ability to repress PCSK9 expression through day 26. The data demonstrate that of these three PCSK9-targeting spacers, when assessed with LTRP5-ADD-ZIM3, use of spacer TG-06-133 resulted in the lowest number of differentially regulated off-target genes. Meanwhile, use of spacer TG-06-154 or TG-06-167 resulted in a higher number of differentially regulated off-target genes, especially at the later timepoint of 26 days post-transfection (Table 71). Furthermore, transient repression using dXR1 and spacer TG-06-138 resulted in minimal transcriptomic changes by day 26.

TABLE 71

Number of differentially regulated off-target genes for each treatment condition compared to untreated, naïve control at the two indicated timepoints. Statistical significance thresholds applied were |log2FC| >2 and adjusted p-value < 0.001.

| Molecule | Spacer | # of differentially expressed genes (off-target) - Day 6 | | # of differentially expressed genes (off-target) - Day 26 | |
|---|---|---|---|---|---|
| | | Downregulated | Upregulated | Downregulated | Upregulated |
| CasX 676 | NT | 0 | 0 | 0 | 0 |
| CasX 676 | 6.1 | 0 | 0 | 0 | 0 |
| dXR1 | NT | 0 | 0 | 0 | 0 |
| dXR1 | TG-06-138 | 3 | 14 | 0 | 1 |
| LTRP5-ADD-ZIM3 | NT | 0 | 0 | 9 | 35 |
| LTRP5-ADD-ZIM3 | TG-06-138 | 2 | 0 | 0 | 0 |
| LTRP5-ADD-ZIM3 | TG-06-154 | 2 | 0 | 6 | 10 |
| LTRP5-ADD-ZIM3 | TG-06-167 | 2 | 0 | 18 | 21 |
| LTRP5-ADD-ZIM3 | TG-06-133 | 2 | 0 | 0 | 0 |
| LTRP5-ADD-ZIM3 | TG-06-146 | 1 | 7 | 0 | 0 |
| LTRP5-ADD-ZIM3 | TG-06-352 | 2 | 1 | 0 | 0 |

These experiments show a preliminary analysis of the genome-wide transcriptomic effects of using an LTRP molecule and a PCSK9-targeting gRNA to repress the PCSK9 locus in human cells. The data from these experiments show that analyzing these genome-wide transcriptomic effects would help with the identification of candidate spacers for targeting the PCSK9 locus.

Example 23: Assessment of PCSK9 Spacers in Achieving in Human Hepatocyte Cells when Paired with an LTRP5-ADD Molecule Experiments were performed to carry out a comprehensive evaluation of PCSK9-targeting spacers, with the TTC recognition motif, when paired with an LTRP molecule in configuration #5 containing the ADD domain (LTRP5; diagrammed in FIG. 2). Briefly, in vitro experiments were conducted to assess spacers that induce durable repression of the human PCSK9 locus, resulting in substantial reduction in PCSK9 secretion.

Materials and Methods

A computational screen was performed as described in Example 3 that resulted in the identification of 69 TTC spacers for subsequent experimental assessment. Of these 69 TTC spacers, 61 spacers were subjected to further in vitro screening using a cell-based assay as described in the ensuing methods. In addition to the 61 spacers, four more spacers were identified in an independent computational screen using methods similar to those described in Example 3, with the addition of one criterion: i.e., TTC spacers that overlapped with a SNP having a minor allele frequency (MAF) of >0.05 were excluded. Therefore, a total of 65 spacers were subjected to an in vitro experiment using a cell-based assay described in the methods that follow. The 61 out of 65 PCSK9-targeting spacers tested in this experiment are listed in Table 72, with the corresponding SEQ ID NOS listed in Table 17. The four additional spacers that were independently identified are shown in Table 73.

TABLE 72

List of 61 out of 65 PCSK9-targeting spacers assessed in this example.

| Spacer ID | Spacer ID | Spacer ID |
|---|---|---|
| TG-06-342 | TG-06-142 | TG-06-002 |
| TG-06-117 | TG-06-144 | TG-06-343 |
| TG-06-118 | TG-06-143 | TG-06-167 |
| TG-06-119 | TG-06-146 | TG-06-168 |
| TG-06-120 | TG-06-145 | TG-06-169 |
| TG-06-122 | TG-06-147 | TG-06-170 |
| TG-06-123 | TG-06-149 | TG-06-344 |
| TG-06-121 | TG-06-150 | TG-06-345 |
| TG-06-124 | TG-06-151 | TG-06-346 |
| TG-06-125 | TG-06-152 | TG-06-347 |
| TG-06-127 | TG-06-153 | TG-06-348 |
| TG-06-128 | TG-06-154 | TG-06-171 |
| TG-06-131 | TG-06-155 | TG-06-349 |
| TG-06-132 | TG-06-157 | TG-06-249 |
| TG-06-135 | TG-06-159 | TG-06-250 |
| TG-06-133 | TG-06-158 | TG-06-251 |
| TG-06-134 | TG-06-160 | TG-06-350 |
| TG-06-138 | TG-06-161 | TG-06-351 |
| TG-06-139 | TG-06-004 | TG-06-172 |
| TG-06-140 | TG-06-001 | |
| TG-06-141 | TG-06-005 | |

TABLE 73

RNA sequences of the four additional TTC spacers targeting the human PCSK9 locus.

| Spacer ID | Spacer RNA sequence | SEQ ID NO: |
|---|---|---|
| TG-06-126 | CCUUUUCAUCCUCCUGCCUG | 2672 |
| TG-06-129 | UUUUACACACCAUGUUCAAG | 2675 |
| TG-06-148 | GCCGGGCCCACCUUUUCAGU | 2694 |
| TG-06-1046 | UCUCUUACAUGGGGGGAAAC | 2714 |

Assessment of PCSK9 Secretion Levels for the 65 PCSK9-Targeting Spacers:

mRNA encoding the LTRP5-ADD-ZIM3 molecule was generated by IVT using methods similar to those described in Example 2. The DNA and mRNA sequences for LTRP5-ADD-ZIM3 are shown in Tables 18 and 19.

gRNAs containing each of the 65 PCSK9-targeting spacers (Tables 72-73) were designed using gRNA scaffold 316 and chemically synthesized with the v1 modification profile (as described in Example 7). Furthermore, a non-targeting gRNA was used as non-targeting control.

To assess PCSK9 secretion, seeded Huh7 cells were co-transfected with mRNA encoding for LTRP5-ADD-ZIM3 and a gRNA with scaffold 316 and spacer targeting the PCSK9 locus using Lipofectamine™ 3000. Two doses of total RNA input at a 2:1 mass ratio of mRNA to gRNA were used for screening: 50 ng mRNA: 25 ng gRNA and 25 ng mRNA: 12.5 ng gRNA. Media supernatant was harvested at 6 days post-transfection to assess level of PCSK9 secretion by ELISA (Table 74). Levels of PCSK9 secretion were normalized to total cell count. As an additional control, PCSK9 secretion was also measured in the media supernatant harvested from cells transfected with mRNA encoding for mScarlet.

Media supernatant is further sampled at 13, 20, and 27 days post-transfection, and levels of PCSK9 secretion are measured by ELISA as described above.

Results

PCSK9 secretion levels for Huh7 cells transfected with mRNA encoding LTRP5-ADD-ZIM3 with a PCSK9-targeting gRNA at the 6-day timepoint are shown in Table 74. Specifically, Table 74 provides the level of secreted PCSK9 (ng/ml) in cells transfected with gRNAs with each of the spacers, the percent reduction in PCSK9 secretion relative to the control transfected with a non-targeting gRNA, and the distance in basepairs of each targeting sequence to the PCSK9 transcription start site (TSS). The average percent reduction in PCSK9 secretion with each dose for each spacer is also provided, and spacers in constructs that resulted in greater than 50% reduction in PCSK9 secretion averaged from the two doses are bolded in the table.

TABLE 74

Results of ELISA assay evaluating the functional effects of 65 PCSK9-targeting spacers on PCSK9 secretion levels when paired with LTRP5-ADD-ZIM3*

| | | 50 ng mRNA:25 ng gRNA | | 25 ng mRNA:12.5 ng gRNA | | Average |
|---|---|---|---|---|---|---|
| Spacer ID | Distance to TSS (bp) | Secreted PCSK9 (ng/mL) | Percent reduction in PCSK9 secretion | Secreted PCSK9 (ng/mL) | Percent reduction in PCSK9 secretion | percent reduction in PCSK9 secretion |
| TG-06-342 | −1086 | 51.55 | 37.34 | 75.23 | 5.6 | 15.87 |
| TG-06-117 | −917 | 68.98 | 16.16 | 98.05 | 37.62 | 10.73 |
| TG-06-118 | −860 | 35.5 | 56.86 | 54.78 | 23.11 | 39.99 |
| TG-06-119 | −858 | 70.37 | 14.47 | 84.54 | 18.66 | 2.1 |
| **TG-06-120** | **−843** | **21.43** | **73.95** | **47.97** | **32.67** | **53.31** |
| TG-06-122 | −800 | 79.36 | 3.54 | 86.06 | 20.79 | 8.63 |
| TG-06-123 | −789 | 30.49 | 62.95 | 51.32 | 27.97 | 45.46 |
| **TG-06-121** | **−787** | **28.33** | **65.57** | **37.13** | **47.89** | **56.73** |
| **TG-06-124** | **−786** | **16.54** | **79.9** | **30.59** | **57.06** | **68.48** |
| **TG-06-125** | **−767** | **24.93** | **69.7** | **46.11** | **35.28** | **52.49** |
| **TG-06-126** | **−707** | **23.48** | **71.46** | **44.82** | **37.09** | **54.27** |
| **TG-06-127** | **−699** | **22.57** | **72.56** | **49.1** | **31.08** | **51.82** |
| TG-06-128 | −664 | 42.21 | 48.7 | 62.29 | 12.57 | 30.63 |
| TG-06-129 | −646 | 59.93 | 27.16 | 90.82 | 27.47 | 0.16 |
| TG-06-131 | −644 | 28.4 | 65.48 | 57.89 | 18.74 | 42.11 |
| TG-06-132 | −621 | 56.68 | 31.11 | 75.01 | 5.29 | 12.91 |
| **TG-06-135** | **−601** | **25.66** | **68.82** | **44.59** | **37.42** | **53.12** |
| **TG-06-133** | **−596** | **29.45** | **64.21** | **42.13** | **40.86** | **52.53** |
| TG-06-134 | −589 | 43.79 | 46.77 | 57.45 | 19.37 | 33.07 |
| **TG-06-138** | **−527** | **18.99** | **76.92** | **30.87** | **56.67** | **66.79** |
| **TG-06-139** | **−463** | **15.03** | **81.73** | **25.45** | **64.28** | **73.01** |
| TG-06-140 | −408 | 61.68 | 25.04 | 59.94 | 15.87 | 20.45 |
| **TG-06-141** | **−383** | **13.86** | **83.16** | **12.58** | **82.34** | **82.75** |
| **TG-06-142** | **−379** | **30.87** | **62.48** | **27.27** | **61.73** | **62.1** |
| **TG-06-144** | **−351** | **23.42** | **71.53** | **29** | **59.29** | **65.41** |
| **TG-06-143** | **−337** | **38.69** | **52.97** | **22.33** | **68.66** | **60.81** |
| **TG-06-146** | **−316** | **40.84** | **50.36** | **20.34** | **71.45** | **60.9** |
| **TG-06-145** | **−299** | **15.8** | **80.8** | **18.54** | **73.98** | **77.39** |
| TG-06-147 | −291 | 53.6 | 34.85 | 37.43 | 47.46 | 41.15 |
| TG-06-148 | −273 | 71.46 | 13.15 | 44.77 | 37.16 | 25.15 |
| **TG-06-149** | **−177** | **21.18** | **74.26** | **38.33** | **46.21** | **60.23** |
| **TG-06-150** | **−148** | **18.33** | **77.73** | **39.59** | **44.42** | **61.08** |
| TG-06-151 | −145 | 53.44 | 35.05 | 66.42 | 6.77 | 20.91 |
| TG-06-152 | −126 | 36.95 | 55.09 | 57.43 | 19.39 | 37.24 |
| TG-06-153 | −76 | 73.23 | 10.99 | 86.58 | 21.52 | 5.27 |
| **TG-06-154** | **−13** | **6.87** | **91.65** | **24.48** | **65.64** | **78.64** |
| TG-06-155 | 18 | 29.45 | 64.21 | 56.36 | 20.89 | 42.55 |
| **TG-06-157** | **70** | **12.32** | **85.03** | **32.4** | **54.53** | **69.78** |
| TG-06-159 | 169 | 53.15 | 35.4 | 80.84 | 13.47 | 10.97 |
| **TG-06-158** | **175** | **9.39** | **88.59** | **31.72** | **55.48** | **72.03** |
| **TG-06-160** | **182** | **20.63** | **74.93** | **48.67** | **31.69** | **53.31** |
| TG-06-161 | 204 | 29.55 | 64.08 | 53.16 | 25.38 | 44.73 |
| TG-06-004 | 448 | 54.83 | 33.35 | 73.05 | 2.54 | 15.41 |
| **TG-06-001** | **451** | **18.21** | **77.86** | **32.86** | **53.88** | **65.87** |
| TG-06-005 | 464 | 67.08 | 18.47 | 76.37 | 7.19 | 5.64 |
| TG-06-002 | 503 | 81.95 | 0.4 | 83.15 | 16.71 | 8.16 |
| TG-06-1046 | 592 | 78.9 | 4.1 | 76.27 | 7.05 | 1.48 |
| TG-06-343 | 598 | 62.8 | 23.67 | 75.55 | 6.04 | 8.82 |
| TG-06-167 | 751 | 39.55 | 51.93 | 66.61 | 6.51 | 29.22 |
| **TG-06-168** | **768** | **19.1** | **76.78** | **50.96** | **28.47** | **52.62** |
| TG-06-169 | 781 | 66.39 | 19.3 | 62.55 | 12.2 | 15.75 |
| TG-06-170 | 786 | 64.19 | 21.98 | 72.96 | 2.41 | 9.79 |
| TG-06-344 | 851 | 82.29 | 0.01 | 76.43 | 7.28 | 3.64 |
| TG-06-345 | 859 | 81.22 | 1.28 | 85.68 | 20.26 | 9.49 |
| TG-06-346 | 861 | 77.02 | 6.39 | 81.63 | 14.58 | 4.09 |
| TG-06-347 | 869 | 26.55 | 67.73 | 51.83 | 27.24 | 47.49 |
| **TG-06-348** | **878** | **23.14** | **71.88** | **35.55** | **50.1** | **60.99** |
| TG-06-171 | 889 | 52.41 | 36.3 | 55.95 | 21.46 | 28.88 |
| TG-06-349 | 908 | 91.34 | 11.02 | 87.55 | 22.89 | 16.95 |

TABLE 74-continued

Results of ELISA assay evaluating the functional effects of 65 PCSK9-targeting spacers on PCSK9 secretion levels when paired with LTRP5-ADD-ZIM3*

| | | 50 ng mRNA:25 ng gRNA | | 25 ng mRNA:12.5 ng gRNA | | Average |
|---|---|---|---|---|---|---|
| Spacer ID | Distance to TSS (bp) | Secreted PCSK9 (ng/mL) | Percent reduction in PCSK9 secretion | Secreted PCSK9 (ng/mL) | Percent reduction in PCSK9 secretion | percent reduction in PCSK9 secretion |
| TG-06-249 | 949 | 87.36 | 6.18 | 82.36 | 15.61 | 10.89 |
| TG-06-250 | 959 | 86.92 | 5.64 | 80.42 | 12.87 | 9.26 |
| TG-06-251 | 985 | 36.8 | 55.28 | 44.62 | 37.37 | 46.32 |
| TG-06-350 | 1063 | 71.25 | 13.4 | 67.87 | 4.74 | 9.07 |
| TG-06-351 | 1074 | 56.34 | 31.52 | 62.93 | 11.67 | 21.6 |
| TG-06-172 | 1097 | 44.44 | 45.99 | 59.31 | 16.75 | 31.37 |
| Non-targeting | — | 82.28 | 0 | 71.24 | 0 | 0 |
| mScarlet mRNA | — | 84.85 | 3.12 | — | — | — |

*Data are shown rounded to the nearest hundredth.

The data presented in Table 74 demonstrate that constructs with most of the tested spacers produced decreased levels of secreted PCSK9 at 6 days post-transfection. The spacers were complementary to the PCSK9 locus in a region ranging from 1086 basepairs upstream to 1097 basepairs downstream of the TSS, and effective spacers were found throughout the tested region, with many of the most effective spacers clustering between the TSS and approximately 500 basepairs upstream of the TSS.

The construct with the TG-06-141 spacer was the most effective overall at the 6-day timepoint, with an 82.75% average reduction in secreted PCSK9 levels. Constructs with spacers TG-06-154, TG-06-145, TG-06-139, TG-06-158, TG-06-157, TG-06-124, TG-06-138, TG-06-001 and TG-06-144 were also highly effective, with each producing greater than a 65% average reduction in secreted PCSK9 levels.

13, 20, and 27 days post-transfection timepoints are further assessed in order to identify spacers that support PCSK9 repression and a reduction of secreted PCSK9 levels over longer time periods.

These results demonstrate that delivery of mRNA encoding an LTRP molecule with the ADD domain with the appropriate targeting gRNA can result in repression of the PCSK9 locus to reduce PCSK9 secretion in a cell-based assay.

Example 24: Additional Assessment of the Effects of Using CpG-Reduced or Depleted gRNA Scaffolds on CasX-Mediated Editing Activity As discussed in Example 12, above, unmethylated CpG motifs act as PAMPs that potently trigger undesired immune activation. Therefore, nucleotide substitutions to replace native CpG motifs in the AAV constructs, including constructs encoding for guide scaffold variants 235 and 316, were designed and generated. Here, experiments were performed to evaluate further the effects of using these resulting CpG-reduced or depleted gRNA scaffolds on CasX-mediated editing activity.

Materials and Methods

The CpG-reduced or depleted scaffolds 320-341 were evaluated in three in vitro experiments described below; the sequences of scaffolds 320-341 are listed in Table 42. In addition, two newly engineered gRNA scaffolds, scaffold 382 and 392 (sequences listed in Table 75), were also assessed. As benchmark comparisons, scaffolds 174, 235, and 316 (sequences listed in Table 9 and Table 75) were also included for evaluation.

TABLE 75

Sequences of additional gRNA scaffolds tested in this example

| Scaffold ID | DNA sequence | DNA SEQ ID NO: | RNA sequence | RNA SEQ ID NO: |
|---|---|---|---|---|
| Scaffold 382 | ACTGGCGCTTCTATCTGATTACTCT GAGCCGCCATCACCAGCGACTATGT CGTAGTGGGTAAAGCTCCCTCTTCG GAGGGAGCATCAGAG | 3448 | ACUGGCGCUUCUAUCUGAUUACUCU GAGCCGCCAUCACCAGCGACUAUGU CGUAGUGGGUAAAGCUCCCUCUUCG GAGGGAGCAUCAGAG | 3451 |
| Scaffold 392 | ACTGGGCCTTCTATCTGATTACTCT GAGGCCCATCACCAGCGACTATGTC GTAGTGGGTAAAGCCGCTTACGGAC TTCGGTCCGTAAGAGGCATCAGAG | 3449 | ACUGGGCCUUCUAUCUGAUUACUCU GAGGCCCAUCACCAGCGACUAUGUC GUAGUGGGUAAAGCCGCUUACGGAC UUCGGUCCGUAAGAGGCAUCAGAG | 3452 |

TABLE 75-continued

| Sequences of additional gRNA scaffolds tested in this example | | | | |
|---|---|---|---|---|
| Scaffold ID | DNA sequence | DNA SEQ ID NO: | RNA sequence | RNA SEQ ID NO: |
| Scaffold 174 | ACTGGCGCTTTTATCTGATTACTTT GAGAGCCATCACCAGCGACTATGTC GTAGTGGGTAAAGCTCCCTCTTCGG AGGGAGCATCAAAG | 3450 | ACUGGCGCUUUUAUCUGAUUACUUU GAGAGCCAUCACCAGCGACUAUGUC GUAGUGGGUAAAGCUCCCUCUUCGG AGGGAGCAUCAAAG | 1744 |

AAV constructs were designed and generated as previously described in Example 12. The CpG-reduced or depleted gRNA scaffolds were tested in two different AAV backbones. Specifically, for the experiment involving lipofection of HEK293 cells as described below, scaffolds 235 and 320-341 were tested in AAV vectors that were CpG-depleted, with the exception of AAV2 ITRs, as previously described in Example 12. Briefly, the CpG-depleted AAV backbone construct encoded for CpG-depleted versions of the following elements: UA promoter, CasX 491, bGH poly(A) signal sequence, and U6 promoter. For the experiment involving AAV transduction of human induced neurons (iNs) and HEK293 cells as described below, scaffolds 174, 235, 316, 320-341, 382, and 392 (see Tables 9, 42 and 75 for sequences) were tested in an AAV backbone that was not CpG-depleted (see Table 76 for sequences). Furthermore, spacer 7.37 targeting the B2M locus was used in two experiments described below involving HEK293 cells: lipofection and AAV transduction. Spacer 31.63 targeting the AAVS1 locus was used in an experiment described below involving human iNs. Table 77 below lists the AAV constructs that were tested in the context of a non-CpG-depleted AAV vector and the experimental conditions in which these constructs were assessed.

TABLE 76

| Sequences encoding for a base AAV plasmid into which gRNA scaffolds in Table 75 were cloned | | |
|---|---|---|
| Component Name | DNA sequence | SEQ ID NO |
| 5' ITR | CCTGCAGGCAGCTGCGCGCTCGCTCGCTCACTGAGGCCGCCCG GGCGTCGGGCGACCTTTGGTCGCCCGGCCTCAGTGAGCGAGCG AGCGCGCAGAGAGGGAGTGGCCAACTCCATCACTAGGGGTTCC T | 3233 |
| buffer sequence | GCGGCCTCTAGACTCGAGGCGTT | 3453 |
| U1A promoter | AATGGAGGCGGTACTATGTAGATGAGAATTCAGGAGCAAACTG GGAAAAGCAACTGCTTCCAAATATTTGTGATTTTTACAGTGTA GTTTTGGAAAAACTCTTAGCCTACCAATTCTTCTAAGTGTTTT AAAATGTGGGAGCCAGTACACATGAAGTTATAGAGTGTTTTAA TGAGGCTTAAATATTTACCGTAACTATGAAATGCTACGCATAT CATGCTGTTCAGGCTCCGTGGCCACGCAACTCATACT | 3454 |
| buffer sequence | CTCTGGCTAACTACCGGT | 3455 |
| Kozak | GCCACC | N.D. |
| start codon + c-MYC NLS | ATGGCCCCAGCGGCCAAACGGGTGAAGCTGGAC | 3456 |
| linker | TCTAGA | N.D. |
| CasX 515 | CAAGAGATCAAGAGAATCAACAAGATCAGAAGGAGACTGGTCA AGGACAGCAACACAAAGAAGGCCGGCAAGACAGGCCCCATGAA AACCCTGCTCGTCAGAGTGATGACCCCTGACCTGAGAGAGCGG CTGGAAAACCTGAGAAAGAAGCCCGAGAACATCCCTCAGCCTA TCAGCAACACCAGCAGGGCCAACCTGAACAAGCTGCTGACCGA CTACACCGAGATGAAGAAAGCCATCCTGCACGTGTACTGGGAA GAGTTCCAGAAAGACCCCGTGGGCCTGATGAGCAGAGTTGCTC AGCCTGCCAGCAAGAAGATCGACCAGAACAAGCTGAAGCCCGA GATGGACGAGAAGGGCAATCTGACCACAGCCGGCTTTGCCTGC TCTCAGTGTGGCCAGCCTCTGTTCGTGTACAAGCTGGAACAGG TGTCCGAGAAAGGCAAGGCCTACACCAACTACTTCGGCAGATG TAACGTGGCCGAGCACGAGAAGCTGATTCTGCTGGCCCAGCTG AAACCTGAGAAGGACTCTGATGAGGCCGTGACCTACAGCCTGG GCAAGTTTGGACAGAGAGCCCTGGACTTCTACAGCATCCACGT GACCAAAGAAAGCACACACCCCGTGAAGCCCCTGGCTCAGATC GCCGGCAATAGATACGCCTCTGGACCTGTGGGCAAAGCCCTGT CCGATGCCTGCATGGGAACAATCGCCAGCTTCCTGAGCAAGTA CCAGGACATCATCATCGAGCACCAGAAGGTGGTCAAGGGCAAC CAGAAGAGACTGGAAAGCCTGAGGGAGCTGGCCGGCAAAGAGA ACCTGGAATACCCCAGCGTGACCCTGCCTCCTCAGCCTCACAC | 3457 |

TABLE 76-continued

Sequences encoding for a base AAV plasmid into which gRNA scaffolds in Table 75 were cloned

| Component Name | DNA sequence | SEQ ID NO |
|---|---|---|
| | AAAAGAAGGCGTGGACGCCTACAACGAAGTGATCGCCAGAGTG AGAATGTGGGTCAACCTGAACCTGTGGCAGAAGCTGAAACTGT CCAGGGACGACGCCAAGCCTCTGCTGAGACTGAAGGGCTTCCC TAGCTTCCCTCTGGTGGAAAGACAGGCCAATGAAGTGGATTGG TGGGACATGGTCTGCAACGTGAAGAAGCTGATCAACGAGAAGA AAGAGGATGGCAAGGTTTTCTGGCAGAACCTGGCCGGCTACAA GAGACAAGAAGCCCTGAGGCCTTACCTGAGCAGCGAAGAGGAC CGGAAGAAGGGCAAGAAGTTCGCCAGATACCAGCTGGGCGACC TGCTGCTGCACCTGGAAAAGAAGCACGGCGAGGACTGGGGCAA AGTGTACGATGAGGCCTGGGAGAGAATCGACAAGAAGGTGGAA GGCCTGAGCAAGCACATTAAGCTGGAAGAGGAAAGAAGGAGCG AGGACGCCCAATCTAAAGCCGCTCTGACCGATTGGCTGAGAGC CAAGGCCAGCTTTGTGATCGAGGGCCTGAAAGAGGCCGACAAG GACGAGTTCTGCAGATGCGAGCTGAAGCTGCAGAAGTGGTACG GCGATCTGAGAGGCAAGCCCTTCGCCATTGAGGCCGAGAACAG CATCCTGGACATCAGCGGCTTCAGCAAGCAGTACAACTGCGCC TTCATTTGGCAGAAAGACGGCGTCAAGAAACTGAACCTGTACC TGATCATCAATTACTTCAAAGGCGGCAAGCTGCGGTTCAAGAA GATCAAACCCGAGGCCTTCGAGGCTAACAGATTCTACACCGTG ATCAACAAAAAGTCCGGCGAGATCGTGCCCATGGAAGTGAACT TCAACTTCGACGACCCCAACCTGATTATCCTGCCTCTGGCCTT CGGCAAGAGACAGGGCAGAGAGTTCATCTGGAACGATCTGCTG AGCCTGGAAACCGGCTCTCTGAAGCTGGCCAATGGCAGAGTGA TCGAGAAAACCCTGTACAACAGGAGAACCAGACAGGACGAGCC TGCTCTGTTTGTGGCCCTGACCTTCGAGAGAAGAGAGGTGCTG GACAGCAGCAACATCAAGCCCATGAACCTGATCGGCGTGGACC GGGGCGAGAATATCCCTGCTGTGATCGCCCTGACAGACCCTGA AGGATGCCCACTGAGCAGATTCAAGGACTCCCTGGGCAACCCT ACACACATCCTGAGAATCGGCGAGAGCTACAAAGAGAAGCAGA GGACAATCCAGGCCAAGAAAGAGGTGGAACAGAGAAGAGCCGG CGGATACTCTAGGAAGTACGCCAGCAAGGCCAAGAATCTGGCC GACGACATGGTCCGAAACACCGCCAGAGATCTGCTGTACTACG CCGTGACACAGGACGCCATGCTGATCTTCGAGAATCTGAGCAG AGGCTTCGGCCGGCAGGGCAAGAGAACCTTTATGGCCGAGAGG CAGTACACCAGAATGGAAGATTGGCTCACAGCTAAACTGGCCT ACGAGGGACTGCCCAGCAAGACCTACCTGTCCAAAACACTGGC CCAGTATACCTCCAAGACCTGCAGCAATTGCGGCTTCACCATC ACCAGCGCCGACTACGACAGAGTGCTGGAAAAGCTCAAGAAAA CCGCCACCGGCTGGATGACCACCATCAACGGCAAAGAGCTGAA GGTTGAGGGCCAGATCACCTACTACAACAGGTACAAGAGGCAG AACGTCGTGAAGGATCTGAGCGTGGAACTGGACAGACTGAGCG AAGAGAGCGTGAACAACGACATCAGCAGCTGGACAAAGGGCAG ATCAGGCGAGGCTCTGAGCCTGCTGAAGAAGAGGTTTAGCCAC AGACCTGTGCAAGAGAAGTTCGTGTGCCTGAACTGCGGCTTCG AGACACACGCCGATGAACAGGCTGCCCTGAACATTGCCAGAAG CTGGCTGTTCCTGAGAAGCCAAGAGTACAAGAAGTACCAGACC AACAAGACCACCGGCAACACCGACAAGAGGGCCTTTGTGGAAA CCTGGCAGAGCTTCTACAGAAAAAAGCTGAAAGAAGTCTGGAA GCCCGCCGTG | |
| linker | GGATCC | N.D. |
| c-MYC NLS | CCAGCCGCGAAGCGAGTGAAACTGGAC | 3458 |
| stop codon | TAA | N.D. |
| buffer sequence | GAATTCCTAGAGCTCGCTGATCAGCCTCGA | 3459 |
| bGH poly(A) signal sequence | CTGTGCCTTCTAGTTGCCAGCCATCTGTTGTTTGCCCCTCCCC CGTGCCTTCCTTGACCCTGGAAGGTGCCACTCCCACTGTCCTT TCCTAATAAAATGAGGAAATTGCATCGCATTGTCTGAGTAGGT GTCATTCTATTCTGGGGGGTGGGGTGGGGCAGGACAGCAAGGG GGAGGATTGGGAAGAGAATAGCAGGCATGCTGGGGA | 3460 |
| buffer sequence | GGTACCGT | N.D. |
| U6 promoter | GAGGGCCTATTTCCCATGATTCCTTCATATTTGCATATACGAT ACAAGGCTGTTAGAGAGATAATTGGAATTAATTTGACTGTAAA CACAAAGATATTAGTACAAAATACGTGACGTAGAAAGTAATAA TTTCTTGGGTAGTTTGCAGTTTTAAAATTATGTTTTAAAATGG ACTATCATATGCTTACCGTAACTTGAAAGTATTTCGATTTCTT GGCTTTATATATCTTGTGGAAAGGAC | 3461 |

TABLE 76-continued

Sequences encoding for a base AAV plasmid into which gRNA scaffolds in Table 75 were cloned

| Component Name | DNA sequence | SEQ ID NO |
|---|---|---|
| buffer sequence | GAAACACC | N.D. |
| Scaffold variants | See sequences listed in Tables 9, 42, and 75 | See sequences listed in Tables 9, 42, and 75 |
| B2M spacer (spacer 7.37) | GGCCGAGATGTCTCGCTCCG | 3137 |
| AAVSI spacer (spacer 31.63) | CAAGAGGAGAAGCAGTTTGG | 3462 |
| Non-targeting spacer (spacer 0.0) | CGAGACGTAATTACGTCTCG | 3232 |
| buffer sequence | TTTTTTTTGGCGGCCGC | 3463 |
| 3' ITR | AGGAACCCCTAGTGATGGAGTTGGCCACTCCCTCTCTGCGCGC TCGCTCGCTCACTGAGGCCGGGCGACCAAAGGTCGCCCGACGC CCGGGCTTTGCCCGGGCGGCCTCAGTGAGCGAGCGAGCGCGCA GCTGCCTGCAGG | 3238 |

TABLE 77

List of AAV constructs and scaffold variants tested in a non-CpG-depleted AAV vector (see Table 76 for sequences) and the experimental conditions in which these constructs were assessed

| AAV construct ID | Scaffold variant | Spacer | Experimental conditions |
|---|---|---|---|
| 262 | 235 | 31.63 | AAV transduction in iNs |
| 263 | 328 | 31.63 | AAV transduction in iNs |
| 264 | 329 | 31.63 | AAV transduction in iNs |
| 265 | 382 | 31.63 | AAV transduction in iNs |
| 266 | 174 | 31.63 | AAV transduction in iNs |
| 267 | 335 | 31.63 | AAV transduction in iNs |
| 268 | 325 | 31.63 | AAV transduction in iNs |
| 269 | 330 | 31.63 | AAV transduction in iNs |
| 270 | 327 | 31.63 | AAV transduction in iNs |
| 271 | 334 | 31.63 | AAV transduction in iNs |
| 272 | 339 | 31.63 | AAV transduction in iNs |
| 273 | 337 | 31.63 | AAV transduction in iNs |
| 274 | 235 | Non-targeting | AAV transduction in iNs |
| 275 | 331 | 7.37 | AAV transduction in HEK293s |
| 276 | 335 | 7.37 | AAV transduction in HEK293s |
| 277 | 316 | 7.37 | AAV transduction in HEK293s |
| 278 | 392 | 7.37 | AAV transduction in HEK293s |
| 279 | 325 | 7.37 | AAV transduction in HEK293s |
| 280 | 334 | 7.37 | AAV transduction in HEK293s |
| 281 | 324 | 7.37 | AAV transduction in HEK293s |
| 282 | 336 | 7.37 | AAV transduction in HEK293s |
| 283 | 330 | 7.37 | AAV transduction in HEK293s |
| 284 | 320 | 7.37 | AAV transduction in HEK293s |
| 285 | 332 | 7.37 | AAV transduction in HEK293s |
| 286 | 321 | 7.37 | AAV transduction in HEK293s |
| 287 | 339 | 7.37 | AAV transduction in HEK293s |
| 288 | 235 | 7.37 | AAV transduction in HEK293s |
| 289 | 235 | Non-targeting | AAV transduction in HEK293s |

AAV production was performed using methods described in Example 12. For the experiment involving lipofection of HEK293 cells as described below, AAV titering was performed following methods described in Example 12. For the two experiments involving AAV transduction of human iNs or HEK293 cells as described below, AAV titering was performed by ddPCR. Cell-based assays evaluating the effects of using CpG-depleted or reduced gRNA scaffolds on editing activity:

In one experiment, ~20,000 HEK293 cells per well were seeded in 96-well plates 24 hours prior to transfection. Seeded cells were then transfected with CpG-depleted AAV plasmids containing various versions of the guide scaffold (scaffolds 320-341). 5 days post transfection, cells were harvested for B2M protein expression analysis via HLA immunostaining following by flow cytometry. A CpG-depleted AAV plasmid with scaffold variant 235 served as an experimental control. An AAV plasmid with a CMV promoter driving mCherry expression was used as a transfection control, and a ~41% transfection rate was observed. The results from this experiment are shown in FIG. 68.

In a second experiment, ~20,000 induced neuron (IN) cells per well were seeded on Matrigel-coated 96-well plates 7 days prior to transduction. AAVs expressing the CasX:gRNA system, containing various versions of the guide scaffold (AAV construct ID #262-274; see Table 77), were diluted in neuronal plating media and added to cells 7 days post-plating. Cells were transduced at three MOIs (3E4, 1E4 or 3E3 vg/cell). 7 days post-transduction, cells were gDNA extraction for editing analysis at the AAVS1 locus using NGS. The results from this experiment are shown in FIGS. 69A-69C.

In a third experiment, ~10,000 HEK293 cells per well were seeded in 96-well plates 24 hours prior to transfection. Seeded cells were then transduced with AAVs expressing the CasX:gRNA system, containing various versions of the guide scaffold (AAV construct ID #275-289; see Table 77). Cells were transduced at three MOIs (1E4, 3E3, or 1E3 vg/cell). 5 days post-transduction, cells were harvested for B2M protein expression analysis via HLA immunostaining following by flow cytometry. The results from this experiment are shown in FIGS. 70A-70C. Results:

Experiments were performed to evaluate further the effects of using CpG-reduced or depleted gRNA scaffolds on CasX-mediated editing activity. In the first experiment (N=1), HEK293 cells were lipofected with CpG-depleted AAV plasmids containing various versions of the gRNA scaffold (scaffolds 320-341, see Table 42 for sequences). B2M protein expression was subsequently analyzed, and the results of the assay are shown in FIG. 68. The data demonstrate that use of scaffolds 320-341 did not improve editing activity at the target B2M locus, since use of these scaffolds produced a lower percentage of cells with B2M$^-$ relative to the level achieved when using an AAV construct containing scaffold 235. These results do not recapitulate the results described in Example 12 (see FIGS. 28-31).

In the second experiment (N=1), human iNs were transduced with AAV particles expressing the CasX:gRNA system, containing various versions of the guide scaffold (AAV construct ID #262-274). Editing at the AAVS1 locus was analyzed, and the results of the assay are shown in FIGS. 69A-69C. The data demonstrate that of the scaffold variants tested, use of scaffold variant 329 and 382 appeared to improve editing at the AAVS1 locus when compared to use of scaffold 235, especially at MOI of 1E4 and 3E3 vg/cell. Furthermore, the effects on editing activity were observed in a dose-dependent manner.

Figure 27A:
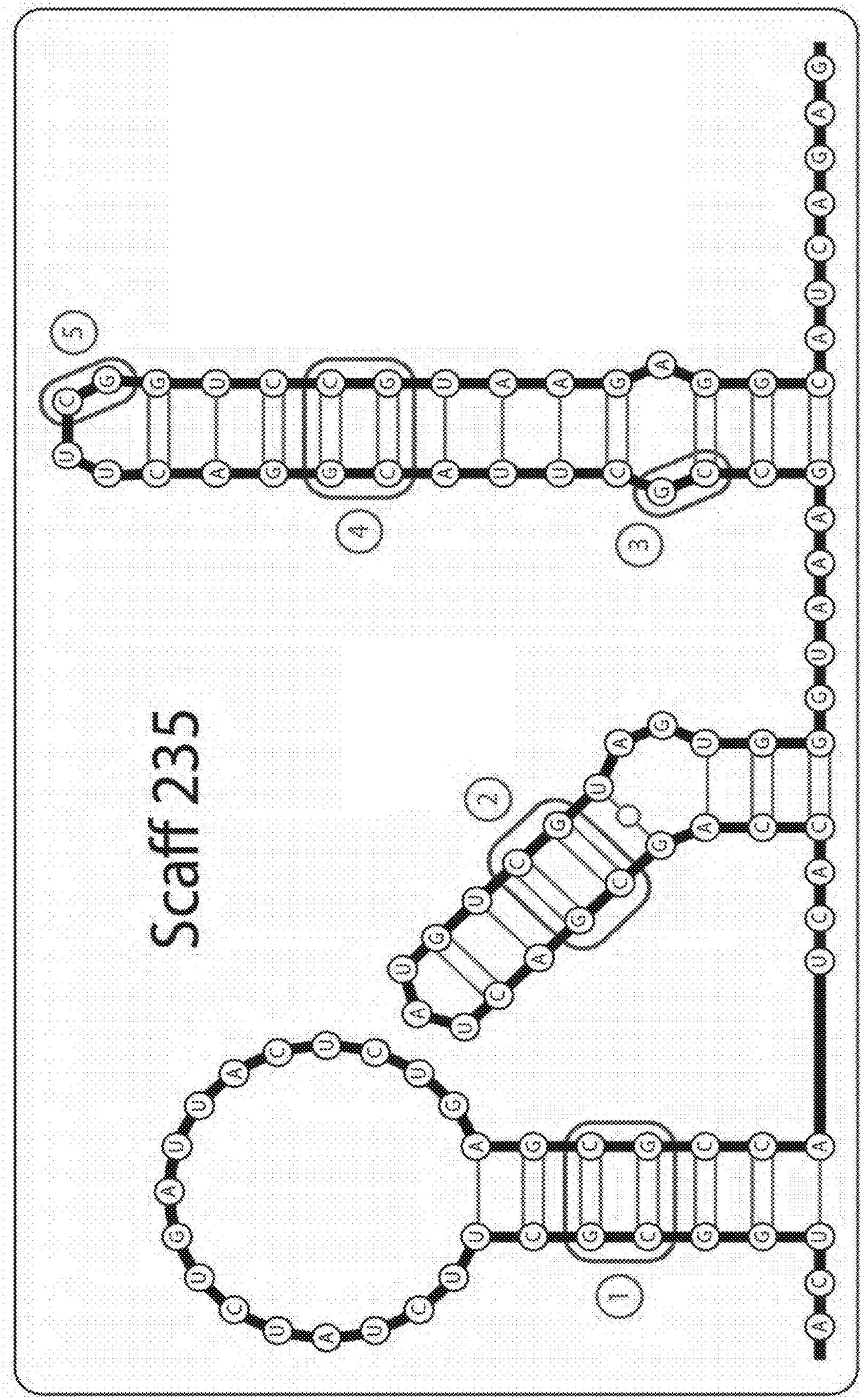
FIG. 27A is a diagram of the secondary structure of guide RNA scaffold 235 (SEQ ID NO: 1745), noting the regions with CpG motifs, as described in Example 12. CpG motifs in (1) the pseudoknot stem, (2) the scaffold stem, (3) the extended stem bubble, (4) the extended step, and (5) the extended stem loop are labeled on the structure.
Figure 27B:
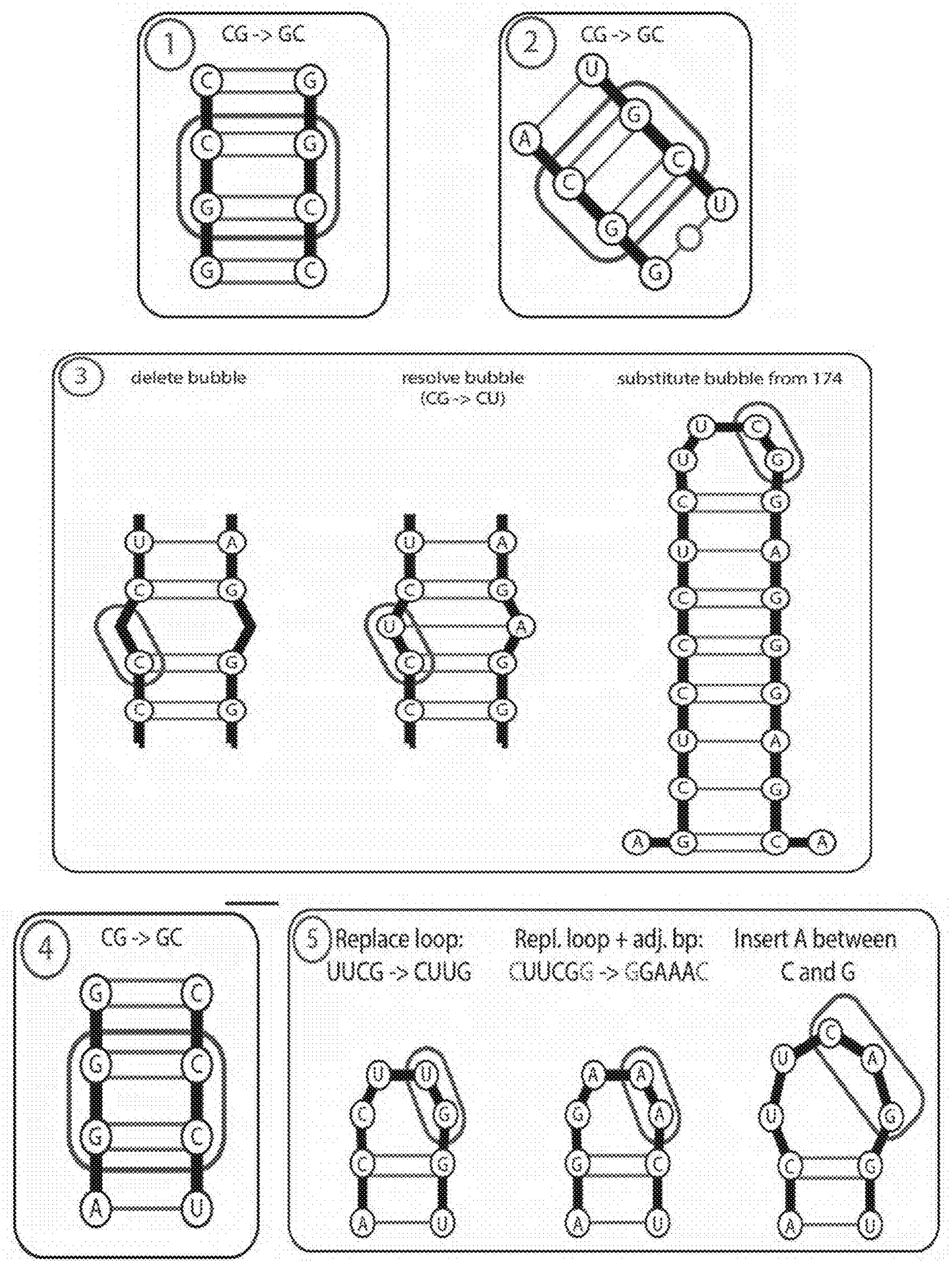
FIG. 27B is a diagram of the CpG-reducing mutations that were introduced into each of the five regions in the coding sequence of the guide RNA scaffold, as described in Example 12. The substitute bubble from scaffold 174 has a sequence of AGCUCCCUCUUCGGAGGGAGCA (SEQ ID NO: 3442).

In the third experiment (N=1), HEK293 cells were transduced with AAV particles expressing the CasX:gRNA system, containing various versions of the guide scaffold (AAV construct ID #275-289). B2M protein expression was subsequently analyzed, and the results of the assay are shown in FIGS. 70A-70C. The data demonstrate that of the scaffold variants tested, use of scaffolds 316, 392 and 332 appeared to improve editing at the B2M locus when compared to use of scaffold 235 overall. Specifically, at the higher MOI of 1E4 and 3E3 vg/cell, slightly improved editing was observed with use of scaffolds 316, 392, and 332 (FIGS. 70A-70B), while a stronger editing improvement was observed at the lower MOI of 1E3 vg/cell (FIG. 70C). Notably, scaffold 332 and 392 both include CG>GC mutations in the pseudoknot stem (region 1; FIGS. 27A-27B), effectively reducing the overall number of CpGs when compared to scaffold 235, thereby potentially contributing to the increase in editing activity. Furthermore, scaffolds 316 and 332 both have a truncated extended stem when compared to scaffold 235, removing the bubble and the CG dinucleotide (region 3; FIGS. 27A-27B), thereby also potentially contributing to the observed increase in editing activity. Further experiments are performed, especially at lower MOIs, to unravel the intricacies of the effects of individual CpG mutations on editing potency.

The results from the experiments described here demonstrate that use of guide scaffolds with different levels of CpG depletion can result in varying levels of editing mediated by the CasX:gRNA system, and that the resulting editing levels can vary by method of delivery (e.g., plasmid transfection vs. AAV transduction).

SEQUENCE LISTING (3467 sequences)

SEQ ID NO: 1 - protein, 986 aa, unidentified
  source 1..986: note = Deltaproteobacteria sp.
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 2 - protein, 978 aa, unidentified
  source 1..978: note = Planctomycetes sp.
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3 - protein, 855 aa, unidentified
  source 1..855: note = Candidatus Sungbacteria sp.
MDNANKPSTKSLVNTTRISDHFGVTPGQVTRVFSFGIIPTKRQYAIIERWFAAVEAARERLYGMLYAHFQENPPAYLKEKFSYETFFKGRPVLNGLRDIDPTIMTSAVFTALRHKAEGAMAAFHTNHRRLFEEARKKMREYAECLKANEALLRGAADIDWDKIVNALRTRLNTCLAPEYDAVIADFGALCAFRALIAETNALKGAYNHALNQMLPALVKVDEPEEAEESPRLRFFNGRINDLPKFPVAERETPPDTETIIRQLEDMARVIPDTAEILGYIHRIRHKAARRKPGSAVPLPQRVALYCAIRMERNPEEDPSTVAGHFLGEIDRVCEKRRQGLVRTPFDSQIRARYMDIISFRATLAHPDRWTEIQFLRSNAASRRVRAETISAPFEGFSWTSNRTNPAPQYGMALAKDANAPADAPELCICLSPSSAAFSVREKGGDLIYMRPTGGRRGKDNPGKEITWVPGSFDEYPASGVALKLRLYFGRSQARRMLTNKTWGLLSDNPRVFAANAELVGKKRNPQDRWKLFFHMVISGPPPVEYLDFSSDVRSRARTVIGINRGEVNPLAYAVVSVEDGQVLEEGLLGKKEYIDQLIETRRRISEYQSREQTPPRDLRQRVRHLQDTVLGSARAKIHSLIAFWKGILAIERLDDQFHGREQKIIPKKTYLANKTGFMNALSFSGAVRVDKKGNPWGGMIEIYPGGISRTCTQCGTVWLARRPKNPGHRDAMVVIPDIVDDAAATGFDNVDCDAGTVDYGELFTLSREWVRLTPRYSRVMRGTLGDLERAIRQGDDRKSRQMLELALEPQPQWGQFFCHRCGFNGQSDVLAATNLARRAISLIRRLPDTDTPPTP

SEQ ID NO: 4 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 5 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTIHTSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 6 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 7 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNHNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 8 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 9 - protein, 978 aa, synthetic construct
RQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 10 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHIQLRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 11 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTTQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 12 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKRSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 13 - protein, 977 aa, synthetic construct
QEIKRINKIRRRLVKDSNTKKAGKTYPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 14 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTIHSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 15 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAATQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 16 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAAKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 17 - protein, 978 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 18 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 19 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASNPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 20 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGWGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 21 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGYGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 22 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 23 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 24 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 25 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRWWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 26 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 27 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 28 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 29 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKKFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 30 - protein, 7 aa, synthetic construct
PKKKRKV

SEQ ID NO: 31 - protein, 16 aa, synthetic construct
KRPAATKKAGQAKKKK

SEQ ID NO: 32 - protein, 9 aa, synthetic construct
PAAKRVKLD

SEQ ID NO: 33 - protein, 11 aa, synthetic construct
RQRRNELKRSP

SEQ ID NO: 34 - protein, 9 aa, synthetic construct
PKKKRKVSR

SEQ ID NO: 35 - protein, 39 aa, synthetic construct
PKKKRKVGGSPKKKRKVGGSPKKKRKVGGSPKKKRKVSR

SEQ ID NO: 36 - protein, 59 aa, synthetic construct
PKKKRKVGGSPKKKRKVGGSPKKKRKVGGSPKKKRKVGGSPKKKRKVGGSPKKKRKVSR

SEQ ID NO: 37 - protein, 11 aa, synthetic construct
PAAKRVKLDSR

SEQ ID NO: 38 - protein, 23 aa, synthetic construct
PAAKRVKLDGGSPAAKRVKLDSR

SEQ ID NO: 39 - protein, 47 aa, synthetic construct
PAAKRVKLDGGSPAAKRVKLDGGSPAAKRVKLDGGSPAAKRVKLDSR

SEQ ID NO: 40 - protein, 71 aa, synthetic construct
PAAKRVKLDGGSPAAKRVKLDGGSPAAKRVKLDGGSPAAKRVKLDGGSPAAKRVKLDGGSPAAKRVKLDSR

SEQ ID NO: 41 - protein, 18 aa, synthetic construct
KRPAATKKAGQAKKKKSR

SEQ ID NO: 42 - protein, 37 aa, synthetic construct
KRPAATKKAGQAKKKKGGSKRPAATKKAGQAKKKKSR

SEQ ID NO: 43 - protein, 21 aa, synthetic construct
PAAKRVKLDGGSPKKKRKVSR

SEQ ID NO: 44 - protein, 21 aa, synthetic construct
PAAKKKKLDGGSPKKKRKVSR

SEQ ID NO: 45 - protein, 11 aa, synthetic construct
PAAKKKKLDSR

SEQ ID NO: 46 - protein, 35 aa, synthetic construct
PAAKKKKLDGGSPAAKKKKLDGGSPAAKKKKLDSR

SEQ ID NO: 47 - protein, 47 aa, synthetic construct
PAAKKKKLDGGSPAAKKKKLDGGSPAAKKKKLDGGSPAAKKKKLDSR

SEQ ID NO: 48 - protein, 13 aa, synthetic construct
PAKRARRGYKCSR

SEQ ID NO: 49 - protein, 26 aa, synthetic construct
PAKRARRGYKCGSPAKRARRGYKCSR

SEQ ID NO: 50 - protein, 9 aa, synthetic construct
PRRKREESR

SEQ ID NO: 51 - protein, 9 aa, synthetic construct
PYRGRKESR

SEQ ID NO: 52 - protein, 10 aa, synthetic construct
PLRKRPRRSR

SEQ ID NO: 53 - protein, 20 aa, synthetic construct
PLRKRPRRGSPLRKRPRRSR

SEQ ID NO: 54 - protein, 32 aa, synthetic construct
PAAKRVKLDGGKRTADGSEFESPKKKRKVGGS

SEQ ID NO: 55 - protein, 34 aa, synthetic construct
PAAKRVKLDGGKRTADGSEFESPKKKRKVPPPPG

SEQ ID NO: 56 - protein, 39 aa, synthetic construct
PAAKRVKLDGGKRTADGSEFESPKKKRKVGIHGVPAAPG

SEQ ID NO: 57 - protein, 39 aa, synthetic construct
PAAKRVKLDGGKRTADGSEFESPKKKRKVGGGSGGGSPG

SEQ ID NO: 58 - protein, 40 aa, synthetic construct
PAAKRVKLDGGKRTADGSEFESPKKKRKVPGGGSGGGSPG

SEQ ID NO: 59 - protein, 48 aa, synthetic construct
PAAKRVKLDGGKRTADGSEFESPKKKRKVAEAAAKEAAAKEAAAKAPG

SEQ ID NO: 60 - protein, 22 aa, synthetic construct
PAAKRVKLDGGSPKKKRKVGGS

SEQ ID NO: 61 - protein, 21 aa, synthetic construct
PAAKRVKLDPPPPKKKRKVPG

SEQ ID NO: 62 - protein, 11 aa, synthetic construct
PAAKRVKLDPG

SEQ ID NO: 63 - protein, 21 aa, synthetic construct
PAAKRVKLDGGGSGGGSGGGS

SEQ ID NO: 64 - protein, 12 aa, synthetic construct
PAAKRVKLDPPP

SEQ ID NO: 65 - protein, 24 aa, synthetic construct
PAAKRVKLDGGGSGGGSGGGSPPP

SEQ ID NO: 66 - protein, 10 aa, synthetic construct
PKKKRKVPPP

SEQ ID NO: 67 - protein, 10 aa, synthetic construct
PKKKRKVGGS

SEQ ID NO: 68 - protein, 39 aa, synthetic construct
GSPKKKRKVGGSPKKKRKVGGSPKKKRKVGGSPKKKRKV

SEQ ID NO: 69 - protein, 59 aa, synthetic construct
GSPKKKRKVGGSPKKKRKVGGSPKKKRKVGGSPKKKRKVGGSPKKKRKVGGSPKKKRKV

SEQ ID NO: 70 - protein, 23 aa, synthetic construct
GSPAAKRVKLDGGSPAAKRVKLD

SEQ ID NO: 71 - protein, 47 aa, synthetic construct
GSPAAKRVKLDGGSPAAKRVKLDGGSPAAKRVKLDGGSPAAKRVKLD

SEQ ID NO: 72 - protein, 18 aa, synthetic construct
GSKRPAATKKAGQAKKKK

SEQ ID NO: 73 - protein, 35 aa, synthetic construct
KRPAATKKAGQAKKKKGGSKRPAATKKAGQAKKKK

SEQ ID NO: 74 - protein, 15 aa, synthetic construct
GSKLGPRKATGRWGS

SEQ ID NO: 75 - protein, 19 aa, synthetic construct
GSKRKGSPERGERKRHWGS

SEQ ID NO: 76 - protein, 31 aa, synthetic construct
GSPKKKRKVGSGSKRPAATKKAGQAKKKKLE

SEQ ID NO: 77 - protein, 30 aa, synthetic construct
GPKRTADSQHSTPPKTKRKVEFEPKKKRKV

SEQ ID NO: 78 - protein, 36 aa, synthetic construct
GGGSGGGSKRTADSQHSTPPKTKRKVEFEPKKKRKV

SEQ ID NO: 79 - protein, 45 aa, synthetic construct
AEAAAKEAAAKEAAAKAKRTADSQHSTPPKTKRKVEFEPKKKRKV

SEQ ID NO: 80 - protein, 40 aa, synthetic construct
GPPKKKRKVGGSKRTADSQHSTPPKTKRKVEFEPKKKRKV

SEQ ID NO: 81 - protein, 28 aa, synthetic construct
GPAEAAAKEAAAKEAAAKAPAAKRVKLD

SEQ ID NO: 82 - protein, 23 aa, synthetic construct
GPGGGSGGGSGGGSPAAKRVKLD

SEQ ID NO: 83 - protein, 11 aa, synthetic construct
GPPAAKRVKLD

SEQ ID NO: 84 - protein, 19 aa, synthetic construct
VGSKRPAATKKAGQAKKKK

SEQ ID NO: 85 - protein, 44 aa, synthetic construct
TGGGPGGGAAAGSGSPKKKRKVGSGSKRPAATKKAGQAKKKKLE

SEQ ID NO: 86 - protein, 26 aa, synthetic construct
TGGGPGGGAAAGSGSPKKKRKVGSGS

SEQ ID NO: 87 - protein, 13 aa, synthetic construct
PPPPKKKRKVPPP

SEQ ID NO: 88 - protein, 13 aa, synthetic construct
GGSPKKKRKVPPP

SEQ ID NO: 89 - protein, 10 aa, synthetic construct
PPPPKKKRKV

SEQ ID NO: 90 - protein, 10 aa, synthetic construct
GGSPKKKRKV

SEQ ID NO: 91 - protein, 19 aa, synthetic construct
GGSPKKKRKVGGSGGSGGS

SEQ ID NO: 92 - protein, 20 aa, synthetic construct
GGSPKKKRKVGGSPKKKRKV

SEQ ID NO: 93 - protein, 26 aa, synthetic construct
GGSGGSGGSPKKKRKVGGSPKKKRKV

SEQ ID NO: 94 - protein, 22 aa, synthetic construct
VGGGSGGGSGGGSPAAKRVKLD

SEQ ID NO: 95 - protein, 13 aa, synthetic construct
VPPPPAAKRVKLD

SEQ ID NO: 96 - protein, 25 aa, synthetic construct
VPPPGGGSGGGSGGGSPAAKRVKLD

SEQ ID NO: 97 - protein, 12 aa, synthetic construct
VGSPAAKRVKLD

SEQ ID NO: 98 - protein, 5 aa, synthetic construct
  VARIANT 2..5: note = individual amino acid residues may be present or absent
GGGGG

SEQ ID NO: 99 - protein, 10 aa, synthetic construct
  VARIANT 3..4: note = grouped amino acid residues may be present or absent
  VARIANT 5..6: note = grouped amino acid residues may be present or absent
  VARIANT 7..8: note = grouped amino acid residues may be present or absent
  VARIANT 9..10: note = grouped amino acid residues may be present or absent
GSGSGSGSGS

SEQ ID NO: 100 - protein, 25 aa, synthetic construct
  VARIANT 6..10: note = grouped amino acid residues may be present or absent
  VARIANT 11..15: note = grouped amino acid residues may be present or absent
  VARIANT 16..20: note = grouped amino acid residues may be present or absent
  VARIANT 21..25: note = grouped amino acid residues may be present or absent
GSGGSGSGGSGSGGSGSGGSGSGGS

SEQ ID NO: 101 - protein, 30 aa, synthetic construct
  VARIANT 7..12: note = grouped amino acid residues may be present or absent
  VARIANT 13..18: note = grouped amino acid residues may be present or absent
  VARIANT 19..24: note = grouped amino acid residues may be present or absent
  VARIANT 25..30: note = grouped amino acid residues may be present or absent
GGSGGSGGSGGSGGSGGSGGSGGSGGSGGS

SEQ ID NO: 102 - protein, 20 aa, synthetic construct
  VARIANT 5..8: note = grouped amino acid residues may be present or absent
  VARIANT 9..12: note = grouped amino acid residues may be present or absent
  VARIANT 13..16: note = grouped amino acid residues may be present or absent
  VARIANT 17..20: note = grouped amino acid residues may be present or absent
GGGSGGGSGGGSGGGSGGGS

SEQ ID NO: 103 - protein, 4 aa, synthetic construct
GGSG

SEQ ID NO: 104 - protein, 5 aa, synthetic construct
GGSGG

SEQ ID NO: 105 - protein, 5 aa, synthetic construct
GSGSG

SEQ ID NO: 106 - protein, 5 aa, synthetic construct
GSGGG

SEQ ID NO: 107 - protein, 5 aa, synthetic construct
GGGSG

SEQ ID NO: 108 - protein, 5 aa, synthetic construct
GSSSG

SEQ ID NO: 109 - protein, 4 aa, synthetic construct
GPGP

SEQ ID NO: 110 - protein, 6 aa, synthetic construct
PPAPPA

SEQ ID NO: 111 - protein, 4 aa, synthetic construct
PPPG

SEQ ID NO: 112 - protein, 7 aa, synthetic construct
PPPGPPP

SEQ ID NO: 113 - protein, 23 aa, synthetic construct
  VARIANT 8..11: note = grouped amino acid residues may be present or absent
  VARIANT 12..15: note = grouped amino acid residues may be present or absent
  VARIANT 16..19: note = grouped amino acid residues may be present or absent
  VARIANT 20..23: note = grouped amino acid residues may be present or absent
PPPGGGSGGGSGGGSGGGSGGGS

SEQ ID NO: 114 - protein, 23 aa, synthetic construct
  VARIANT 1..4: note = grouped amino acid residues may be present or absent
  VARIANT 5..8: note = grouped amino acid residues may be present or absent
  VARIANT 9..12: note = grouped amino acid residues may be present or absent
  VARIANT 13..16: note = grouped amino acid residues may be present or absent
GGGSGGGSGGGSGGGSGGGSPPP

SEQ ID NO: 115 - protein, 17 aa, synthetic construct
AEAAAKEAAAKEAAAKA

SEQ ID NO: 116 - protein, 16 aa, synthetic construct
VPPPGGGSGGGSGGGS

SEQ ID NO: 117 - protein, 15 aa, synthetic construct
TGGGPGGGAAAGSGS

SEQ ID NO: 118 - protein, 15 aa, synthetic construct
GGGSGGGSGGGSPPP

SEQ ID NO: 119 - protein, 12 aa, synthetic construct
TPPKTKRKVEFE

SEQ ID NO: 120 - protein, 7 aa, synthetic construct
GGSGGGS

SEQ ID NO: 121 - protein, 7 aa, synthetic construct
GSGSGGG

SEQ ID NO: 122 - protein, 27 aa, synthetic construct
SSGNSNANSRGPSFSSGLVPLSLRGSH

SEQ ID NO: 123 - protein, 80 aa, synthetic construct
GGPSSGAPPPSGGSPAGSPTSTEEGTSESATPESGPGTSTEPSEGSAPGSPAGSPTSTEEGTSTEPSEGSAPGTSTEPSE

SEQ ID NO: 124 - protein, 6 aa, synthetic construct
GGSGGG

SEQ ID NO: 125 - protein, 135 aa, synthetic construct
ERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFAN

SEQ ID NO: 126 - protein, 301 aa, synthetic construct
NHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 127 - protein, 215 aa, synthetic construct
MGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 128 - protein, 71 aa, synthetic construct
DAKSLTAWSRTLVTFKDVFVDFTREEWKLLDTAQQIVYRNVMLENYKNLVSLGYQLTKPDVILRLEKGEEP

SEQ ID NO: 129 - protein, 99 aa, synthetic construct
NNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESL

SEQ ID NO: 130 - protein, 81 aa, Columba livia
QDVVTFKDVAIYFSPEEWVRLSAGQRELYQEVMLDNYELVTSLDRESKLLYKMDPEEESCEGVPYSSADSGAPDSSSTSAC

SEQ ID NO: 131 - protein, 81 aa, Rattus norvegicus
ALVTFEDVAVRFTQEEWALLDPSQKILYRDVMRETYRNLTSVGINWECWDLEACFRSLGRNLRVQVVKRKCELTNSGPCAE

SEQ ID NO: 132 - protein, 81 aa, Cebus imitator
SKAPITFGDLAIYFSQEEWEWLSPIQKDLYEDVMLENYRNLVSLGLSFRRPNVITLLEKGKAPWMVEPARRRRGPDSGSKV

SEQ ID NO: 133 - protein, 81 aa, Pan troglodytes
EMGLLTFRDIAIEFSLEEWQCLDCAQRNLYRDVMLENYRNLVSLGIAVSKPDLITCLEQNKESQNIKRNKMVAKHPVMHSH

SEQ ID NO: 134 - protein, 81 aa, Chlorocebus sabaeus
SQESVAFEDVAVYFTTKEWAIMVPAERALYRDVMLENYEAVAFVAVPPTSKPALVSHLEQGKESCFIRPPGVLSRSDWRAG

SEQ ID NO: 135 - protein, 81 aa, Ophiophagus hannah
STPVTFEDVVVYFTAAEWVHLTNWQRDFYQAVMMETYELVASVAGDGVPMAEDEEGGVERPVWQYIPRGKRRRKTPQPRAD

SEQ ID NO: 136 - protein, 81 aa, Ailuropoda melanoleuca
LLTFEDVAVSFSEEEWELLDPPQKTLYNDVMQENYETVISLGLKLKNDTGNDQPISISALEMQASGSKVLRKARMKVAQKT

SEQ ID NO: 137 - protein, 84 aa, Peromyscus maniculatus
VTYNDVHVDITQEEWALMDPSQRNLYKDVMVETYMNLTAIGYNWENLEVEEPCQNPLKHGRHERPHTGEKPYEYNQCGKAFAQP

SEQ ID NO: 138 - protein, 90 aa, Phyllostomus discolor
VAFRDVIVDFTQEEWQQLKPAQKDLYRDVMMEIYWNLVSLDLETEGDMNEPDPEKDSWEDRTSIVVVEGLMRNGAQGYACEKAGIQGCRV

SEQ ID NO: 139 - protein, 81 aa, Pan paniscus
MAFEDVAVYFSQEEWGLLDTAQRALYRRVMLDNFALVASLGLSTSRPRVVIQLERGEEPWVPSGTDTTLSRTTYRRRNPGS

SEQ ID NO: 140 - protein, 81 aa, Colobus angolensis
SQGSVTFRDVAIDFSQEEWKWLQPAQRDLYRRVMLENYGHLVSLGLSISKPDVVSLLEQGKEPWLGKRNVKRDLFSASESS

SEQ ID NO: 141 - protein, 81 aa, Colobus angolensis
VQEPVTFKDVAVDFTQEEWGQLDLVQRTLYRDVMLETYGHLLSVGNQIAKPEVISLLEQGEEPWSVEQACPQHTCPEWMRN

SEQ ID NO: 142 - protein, 81 aa, Mandrillus leucophaeus
WPESVTFEDVAVYFTQNQWASLDPAQRALYGEVMLENYANVASLVAFPFPKPALISHLERGEAPWGPDPWDTEIPRGISQG

SEQ ID NO: 143 - protein, 81 aa, unidentified
  source 1..81: note = Bos indicus x Bos taurus
SQSPLTFGDVAVEFSGEEWAWLDSAQRSLHRSVMLENYRNLASLGLCLSKPEMISSLEQRKEPWAVKRKSTRGMHPDSQTL

SEQ ID NO: 144 - protein, 81 aa, Felis catus
FQEAVTFKDVAVVFTEEELGLLDPPQRKLYREVMLENFRNLVSVGHSSSKPDVISQLEREEKLCVKEIHTQRGRHSGGRNQ

SEQ ID NO: 145 - protein, 81 aa, Physeter macrocephalus
KEAFVAFGDVAVDFTQEEWRLLSPAQRTLHREVMLETYNHLVSLEIPFSKPKLISQLERGEEPWIEERQRPLGLCPASRPT

SEQ ID NO: 146 - protein, 81 aa, Callorhinus ursinus
QAEVTFEDVAVLFSREEWGRLGPAQRGLYRDVMLETYRNLVSLGAGPAGPKPGVITQLERGDEPWVLDAQGAKGKERLRVS

SEQ ID NO: 147 - protein, 81 aa, Pan paniscus
MMFQDSVAFEDVAVTFTQEEWALLDPSQKNLYRDVMQETFRNLASIGKKWKPQNIYVEYENLRRNLRIVGERLFESKEGHQ

SEQ ID NO: 148 - protein, 81 aa, Pan paniscus
QDPSAEGLSEEVPVVFEELPVVFEDVAVYFTREEWGMLDKRQKELYRDVMRMNYELLASLGPAAAKPDLISKLERRAAPWI

SEQ ID NO: 149 - protein, 81 aa, Pongo sp.
MIQAQESITLEDVAVDFTWEEWQLLGAAQKDLYRDVMLENYSNLVAVGYQASKPDALFKLEQGEQPWTTEDGIHSGACSDM

SEQ ID NO: 150 - protein, 81 aa, Hylobates sp.
MDSVAFEDVAVNFTQEEWALLDPSQKNLYREVMQETVRNLASIGKKWNNQYIEDEHQNPRKNLRRLIGERLSESKESHQHG

SEQ ID NO: 151 - protein, 81 aa, Callithrix sp.
MPGPPGSLEMDPLTFRDVAIEFSLEEWQCLDTAQQNLYRNVMLENYKNLAFLGIAVSKPDLITRLEKEKEPWKMKRHRMVD

SEQ ID NO: 152 - protein, 81 aa, Callithrix sp.
EAVTFKDVAVFFTEEELGLLDLAQRKLYRDVMLENFRNLLSVGHQPFHQDVFHFLREEKFWMMETATQREGNSGENASVHP

SEQ ID NO: 153 - protein, 81 aa, Callithrix sp.
RALTPVSMTAEAKCTGFTQGSVTFEDVAIYFSQEEWGLLDEAQRLLYRDVMLENFALLTSLVCWHGMEDEETPEQSVSVNG

SEQ ID NO: 154 - protein, 81 aa, Callithrix sp.
QDPSAERLMEEVPVVFEELPVVFEDVAVYFTREEWGMLDKRQKELYRDVMRMNYELLASLGPAAAKPDLISKLERRAAPWI

SEQ ID NO: 155 - protein, 81 aa, Aotus trivirgatus
LAPEDHGSSYEGSVSFRDVAIDFSREEWRHLDLSQRNLYRDVMLETYSHLLSVGYQVPEAEVVMLEQGNEPWSLQGERPHQ

SEQ ID NO: 156 - protein, 81 aa, Aotus trivirgatus
MAAAALRLPAQGTVTFEDVAVKFSQEEWSLLSEAQRCLYHDVMLENLALISSLGCWYGANDETPSKQTLSIQQQSPLRSHW

SEQ ID NO: 157 - protein, 81 aa, Saimiri boliviensis
SVTFEDVAVNFSLEEWNLLNEAQRCLYRDVMLETLTLISSLGAPPHTLFPARACGPEAPPSRHCPRPSLCLSLSPLHPTGV

SEQ ID NO: 158 - protein, 81 aa, Alligator sinensis
MELREAFEDVAVYFTRKEWELLEDEDKELYRDLMLRNYQALVSLGYQGPTPGLICRIKQREVELWVCDDEHHGESSVSENL

SEQ ID NO: 159 - protein, 81 aa, Pantherophis guttatus
QGSVSFEDVAVYFTEEEWALLDSSQRALHREVMLENSRNLAAVGYGQEHKNYQEPSLALFQSEERMLGIQRVLQKTRRSCL

SEQ ID NO: 160 - protein, 81 aa, Xenopus laevis
LVKFEEVAVVFSEDEWNLLSDQQRGLYMEVMKENYEHLIYLGYEVPVILSLLQDGGGISSDAGSQSKSQQVAVAEGSNVNS

SEQ ID NO: 161 - protein, 81 aa, Microcaecilia unicolor
TQVPVTFEDVAVYFCEGEWETLAEWQKELYRETMKENYETLTSLGFSSKKPSLISKIEREEDPCVRDKQDSRDRRRLRSCW

SEQ ID NO: 162 - protein, 81 aa, Mus caroli
SQCLLTFGDVSVDFSQEEWECLDSAQRALYIDVMLENYSNLVSVENYSTCDTVHQHVNTGKESCQRNNLGEMLRNPSHDAL

SEQ ID NO: 163 - protein, 81 aa, Marmota monax
NEMVTFKDVAVVFSGEELELLDSAQWKLYQDVMLENFRNLLSVGGRIQTELETFPEAGPHEELSWQQIWEQIASDSTFSQD

SEQ ID NO: 164 - protein, 81 aa, Mesocricetus auratus
ARVAVMFSDVSIAFSQEEWEYLDLAQRDLYKDVMMENYRNVASLAGCFISKPDVISLLEQGKEPWKVVRKRRRNPDLETKD

SEQ ID NO: 165 - protein, 81 aa, Peromyscus maniculatus
PQSLLSFGDVAVDFSQEEWEYLDYDQRTLYMDVMLENYSNLVFVENHRIYGKYEKDLDQGTKHIAHEDVIIQEKSYKCNEL

SEQ ID NO: 166 - protein, 81 aa, Peromyscus maniculatus
IQNTVTYDDVHIDFTWEEWTLLDPSQRNLYKDVMVETYTNLTAVGYSWEDHNMEEHCQSSQRQRRYKRSNTGEKPCEYTQC

SEQ ID NO: 167 - protein, 81 aa, Mus musculus
MNAVTYEDVHVNFTQEEWALLDPSQKKLYKDVMLETYRNLNAIGFNWDSKIFKNIVQVLEDTEGMKEVRVQRKRLNILNVI

SEQ ID NO: 168 - protein, 81 aa, Octodon degus
AVTMEDVTVTFTNEEWALLNPAQKRLYGDVMWETFRTISAIGRTWDSQQMEEEYKNYLRNLSNEEVAKCCRYTTFNQHENI

SEQ ID NO: 169 - protein, 81 aa, Dipodomys ordii
SNKLVSFDDVAVEFSWEEWQELDISQRTLYRDVMLETYSMLVSLGHTGPKPQLIVKLEQDEESYMREASDKNFSDVQKMKH

SEQ ID NO: 170 - protein, 81 aa, Colobus angolensis
KPGAVSFADVAVYFSPEEWGCLRPAQRALYRDVMRETYGHLGALGFPGPKPALISWMEQESEAWSPAAQDPEKGERLGGAR

SEQ ID NO: 171 - protein, 81 aa, Chlorocebus sabaeus
FQEPLKFRDVAVEFSLEEWQCLDTIQQNLYRNVMLENYRNLVFLGIAVSKPDLITCLEQEKEPWTRKRHRMVAKPVTCSHF

SEQ ID NO: 172 - protein, 81 aa, Capra hircus
SQGRLRFQDVAIDFTLEEWECLDLGQRELYRDVMLENYGNLASLGLIVCKPDLVTFLEKMRDPQDVRGIETTAIHPDLASF

SEQ ID NO: 173 - protein, 81 aa, Bos mutus
SQSPLTFGDVAVEFSGEEWAWLDSAQRSLHRSVMLENYRNLASLGLCLSKPEMISSLEQRKEPWAVKRKSTRGMRPDSQTL

SEQ ID NO: 174 - protein, 81 aa, Nomascus leucogenys
RAEEAVTFKDVAVVFTEEELQLLDLAQRKLYRDVMLENFRNLLSVGHQPFHGDTFHFLREEKFWVMETTSQREGNSGGKIQ

SEQ ID NO: 175 - protein, 81 aa, Sus scrofa
FQAPVTFGDLAIYFSQEEWECLSPIQKDLYEDVMLENYQNLVSLGLSFRRPNVITLLEKGKAPWMVEPVKRRRGLDLGSKC

SEQ ID NO: 176 - protein, 81 aa, Neophocaena asiaeorientalis
SQGPVSFEDVAVDFTQEEWQQLDPAQRTLYRDVMLENYSHLVSVGYPVSKPGVISKLEQGEEPWIMKRDISNWIYPDRETR

SEQ ID NO: 177 - protein, 81 aa, Macaca fascicularis
SQESVAFEDVAVYFTTKEWAIMVPAERALYRDVMLENYEAVAFVVPPTSKPALVSHLEQGKESCFIRPQGVLSRSDWRAGL

SEQ ID NO: 178 - protein, 81 aa, Macaca fascicularis
FQGSISFKDVTVGFTQEEWQHLDPSQRALYRDVMLENYSNLVSVGYCVHKPEVISRLEQGEEPWRLEEEFPSQSFPVWTAD

SEQ ID NO: 179 - protein, 81 aa, Phascolarctos cinereus
PQESVTFKDVAVDFTWEEWGYLDTSQKELYQEVMLENYRNLVSLGFVVAKPDVISQLEQGEAPWRPEGRFPRSRHPDSDTR

SEQ ID NO: 180 - protein, 81 aa, Gorilla sp.
CYQDSVTFDDVAVDFTQEEWTLLDSTQRSLYSDVMLENYKNLATVGGQIIKPSLISWLEQEESRTVQGGVLRGRKTQWRGT

SEQ ID NO: 181 - protein, 81 aa, Acinonyx jubatus
PQESVTFKDIAVDFTQEEWALLDASQRKLYRDVMLENIGHLVSVGYRVCKSDVISQLQQGVELWREGRGFPQGVIPDRKSS

SEQ ID NO: 182 - protein, 81 aa, Cebus imitator
MGQLTFNDVTIEFSLEEWQCLDKPQQNLYREVMLENYRNLVFLGIAVSKPDLITCLKQGKEPWNIRRHEMVTKPPAMCSHF

SEQ ID NO: 183 - protein, 81 aa, Callithrix jacchus
VWGPLSFMDVFVDFTWEEWQLLDPAQKCLYRSVMLENYSNLVSLGYQHTKPDIIFKLEQGEELCMVQAPIPNQCCPNKVWK

SEQ ID NO: 184 - protein, 81 aa, Acinonyx jubatus
FQASVVFEDVAVNFTPEEWALLNRGQRKLYRDVMLETCRNLSAVGKDGSIPSLVFSEKQKFHSSGDLTRMQEGLLRSPLVE

SEQ ID NO: 185 - protein, 81 aa, Lipotes vexillifer
SQEQVSFKDVCVDFTREEWYLLDPAQKILYRDVILENYSHLVSVGNCITKPEVIFKIEQGEEPWILEERFPKQCCSERNWK

SEQ ID NO: 186 - protein, 81 aa, Sapajus apella
MVSFEDVAVLLSQEEWDCLIPAQRGLYRDVMLETYGNLVSLGLQASKPDVISRLEQGDEPWTTHTLRMQGSWSWRHKREGC

SEQ ID NO: 187 - protein, 81 aa, Otolemur garnettii
SQASVSFKDVNVEFTQDEWQQMGPAQRNLYRDVMLENYSNLVSVGYCIFKPKVIFRLEQGEEPWSSEEEFSSQRRPKNYRD

SEQ ID NO: 188 - protein, 81 aa, Otolemur garnettii
LQELLTFKDVSVEFSVDEWACLDPAQQTLYRDVMLENYRHLVFLGLTPSKPHLITCLEQSKEPWKVKAYQTVVKHPAVSNH

SEQ ID NO: 189 - protein, 81 aa, Monodelphis domestica
AQVLVTFQDVAVDFTQEEWRLLDPGQKELYKEVMLENVQNVLSLGLPVPREDWISHFDQGRAPWMLEGEGPSNSCLGRERR

SEQ ID NO: 190 - protein, 81 aa, Physeter macrocephalus
RVVFEDVAVYFSQEEWGLLDEAQRHLYHAVMTENFALVTSLGCWHGAQYEEAPSEQSVSVGMSEVGTPKPDPSTKKAQPYE

SEQ ID NO: 191 - protein, 81 aa, Aotus trivirgatus
IQGQVNFEDVFVYFSQEEWVLLDEAQRLLYRDVMLENFALMASLGHTSFTSHTVASLVMGPDWVDVTPAVATGTLSGSGPG

SEQ ID NO: 192 - protein, 81 aa, Enhydra lutris
VFQGSLSFEDVTVDFSREEWRLLDLAQKSLYRDVMLENYFNLISVGCQVPKQEVLFSLEQEEPRMLDGEISSHNCLGGDIG

SEQ ID NO: 193 - protein, 81 aa, Monodelphis domestica
FQASVTFKDVAVDFTWEEWRLLDPPQKELFWEVMLENYRNLVCLGLADSNKDVMMSKLESGEPHWIPTGGVLRSCWPGWES

SEQ ID NO: 194 - protein, 81 aa, Aotus trivirgatus
KPGAVSFADVAVYFSPEEWGCLRPAQRALYRDVMRETYGHLGALGFPGPKPALISWMEQESEAWSSAAQDPEKGENLGGAR

SEQ ID NO: 195 - protein, 81 aa, Rhinopithecus roxellana
VQEPVTFKDVAVDFTQEEWGQLDLVQRTLYRDVMLETYGHLLSVGNQIAKPEVISLLEQGEEPWSMEQACPQRTCPEWMRN

SEQ ID NO: 196 - protein, 81 aa, Ursus maritimus
VQSHVVFEDVAIYFSQEEWGLLDEAQRFLYHAVMLENFALLSSLGCWHGAQDEQALSEQGVSVGGSQVRTPKPAPSIQKSQ

SEQ ID NO: 197 - protein, 81 aa, Ovis aries
TQLTVEDVDIKFTPEEWECLDPAQRALYWDVMEETYRNLLSVDVSHIHMTKKLQAKANSGKGEILQTVMFGRAETHEIKDF

SEQ ID NO: 198 - protein, 81 aa, Callorhinus ursinus
AEGHVTFEDVAVYFSWEEWGLLDEAQRLLYRDVMLENLALMASLGLASSRTHEITQLEWWREPFLPPCGVVTAAMPRGWRR

SEQ ID NO: 199 - protein, 81 aa, Neovison vison
LVSFEDVAMDFSREEWQQLDPAQRCLYQDVMLEIYSHLLSVEGALGLKTSQQKIFEKASFHNGKESEVTRGGMWCSISEDL

SEQ ID NO: 200 - protein, 81 aa, Pteropus vampyrus
EQESVSFKDVTIDFSREEWQQLDFAQKSLYRDVMLENYFNLISVGCQVPKPEVIFNLEQVENSCMLHRKISRQSCLDGDIG

SEQ ID NO: 201 - protein, 81 aa, Equus caballus
PKVPVTFDDVAVYFSESEWGRLDKWQKELYKHVMRGNYEMLVSLDYAISKPDILTRMERGEEPCPDGPWGPEEGKEREAAR

SEQ ID NO: 202 - protein, 81 aa, Lipotes vexillifer
SQGLVAFEDVAVYFSLEEWERLDADQRELYQEVMQENYGILVSLGYPIPKPDLIFRLEQGEEPWVPDSPRPEEGDIVTGVY

SEQ ID NO: 203 - protein, 81 aa, Equus caballus
MEGLVMFRDVAVDFSQEEWACLDPAQRGLYRDVMLENYHHLVSLGLSLSKPDVISLLEQGKEPWMVSRNMAGGWCPDRLKN

SEQ ID NO: 204 - protein, 81 aa, Zalophus californianus
VRMPVTFEDVAVTFTQEEWGQLDPAQRTLYQEVMLETCGLLVSLGCPLPKPELFYPLDHSPELQTLKRGLSPNSCPGDSTK

SEQ ID NO: 205 - protein, 81 aa, Pan paniscus
GPLTFRDVAIEFSQEEWKSLDPVQKALYWDVMLENYRNLVFLGILPKCMTKELPPIGNSNTGEKCQTVMLERHECYDVENF

SEQ ID NO: 206 - protein, 80 aa, Vicugna pacos
MAPSQGRLTFEDVAIEFSQEEWECLDPAQRALYGEVMLETYRNLVSLGLTSKDSCSLRKKPRRRRRGQKRTREWPLLRYH

SEQ ID NO: 207 - protein, 81 aa, Carlito syrichta
SQGLLTFKDVAIEFSPEEWEYLDPPQRMLYRTVMLENHRNLVFLGLAVSKPDLIMCLEQRREPWNVKSHSKLAKSPAVTSH

SEQ ID NO: 208 - protein, 81 aa, Saimiri boliviensis
MAFEDVAVYFSQEEWGLLDTAQRALYRRVMLDNFALVASLGLSTTRPRVVIQLERGEEPWVPSGTDMTMSRNAHRRRNPGS

SEQ ID NO: 209 - protein, 81 aa, Lynx pardinus
FQGSLSFEDVTVGFSQEEWQHLDPAQRTLYRDVMLENYSHLVAVGCCVPKPDVIFRLEQGQQPWLVEEESLDQIWPEVCRV

SEQ ID NO: 210 - protein, 81 aa, Myotis brandtii
SLALVTFKDVLVNFTREEWKLLDAAQQVMYRDVMLENYRNLVSLGHRLPKPDVILQLEKGEEPWLVERGTHQDAHPDWDTA

SEQ ID NO: 211 - protein, 80 aa, Ursus maritimus
LQRLLTFGDVAIEFSQEEWRCLSHTQRELYRDVMLENYRHLLFLGLIVSKPDLVSLLEQRKEPWDVKRKKTVVFDPGRWE

SEQ ID NO: 212 - protein, 81 aa, Sapajus apella
ALRSVMFSDISIDFSPEEWDCLDLEQKDLYRDVMLENYSNLVSLGCFISKPDVISLLEQGKEPWKVVRKRRGQCPDLQTKY

SEQ ID NO: 213 - protein, 81 aa, Desmodus rotundus
SVTFRDVIVDFTQEEWQQLKPAQKDLYRDVMMEVYWNLVSLDVETRPDAKESDPQEDDWEDRPSVVVIAEGPTRNGARSYT

SEQ ID NO: 214 - protein, 81 aa, Geotrypetes seraphini
DRVKFTFSDVAVYFSEEEWQLLEEQQKELYQNVMKENYTTLMSLGYTTVKPDVISKIEQGKQPLVSSPSGSKGRRAIGRPS

SEQ ID NO: 215 - protein, 81 aa, Geotrypetes seraphini
MQVKFEDVAVSFSQEEWEYLDEGQKELYREVMKENYETLLSLGLKCLQKIHESDRPFTYPACGKSFNHQSNLRKHKRNHTG

SEQ ID NO: 216 - protein, 81 aa, Meleagris gallopavo
CSKEPLCLQEPVSFADVAVYFSREEWALLDPAQRALYWDVMLETYECIASLGGEDPWIPDVHGLKDMAGDTCPGDGIADLK

SEQ ID NO: 217 - protein, 81 aa, Gopherus agassizii
VTFEEVAVYFSEEEWALLDPGQRALYRDVMQENYETVISLGKDFCPLSPEQVALCGMLCGRSEGHVSQSPEQRETCKRQHK

SEQ ID NO: 218 - protein, 81 aa, Octodon degus
LLTFEDVAVHFSEEEWQLLDPNQKTLYNEVMWDICEAASFVGLKFKNDTGNAEPSSVSALEIQAAERQGSKTRKNVARKRK

SEQ ID NO: 219 - protein, 81 aa, Bos mutus
QPQGTMTFKDVEVTFSQDEWGLLDASQRNLYRDVMLENYGNMASVVGPFTKPALISWLEAREPWGLNVQGVQFKGNPGAAP

SEQ ID NO: 220 - protein, 81 aa, Callithrix jacchus
TQGSLTFKDVAIEFSQEEWKCLDPVQKALYRDVMLENYRNLGFLGLCLPDLDIISMLEQGKEPWTVVSQVKITRNPNCGEC

SEQ ID NO: 221 - protein, 81 aa, Colinus virginianus
GEEPVNFEEVAVYFSREEWALLDPAQRALYRDVMLETYECVASLAPLPAPKPMVISLLEEGEEPWIPDVGSPEAVAGDVSP

SEQ ID NO: 222 - protein, 81 aa, Monodelphis domestica
SQESVTFQDVTVDFTQEEWCMLDCSQKKLYREVMLENVQNLLSVGLPVPRENLLSSCQQGDSPWLLEQKGTRIFRADAEIC

SEQ ID NO: 223 - protein, 87 aa, Physeter macrocephalus
VTFEDVAVNFTLEEWALLDPSQKKLYRDVMRETLRNLASVGEKWEDHDIEDQYKNQGRKLRSHVLERLCESKEGSQCGENFSLIPNL

SEQ ID NO: 224 - protein, 93 aa, Micrurus lemniscatus
FREVSVYFSEEEWSWLDPDQKALYWEVMLENHRNMASLGDDGQENKDSYELLQGITARDTMETSAIEMEVERYKEKQSDDWNQESSSCTDDSV

SEQ ID NO: 225 - protein, 81 aa, Vicugna pacos
SQHLVTFEDVAVNFTQEEWTLLDQTQRDLYRDVMLENYQNLMALGSESCKPHVNSPLEGAEELRTRARRILQSEFMAESDL

SEQ ID NO: 226 - protein, 81 aa, Odobenus rosmarus
FLLGLLTFRDVAIEFSQEEWGCLNHTQRELYRDVMLENYGHLLFLGLIVSKPDLVSFLEQKKEPWDVKRKKTVAIHRGRWE

SEQ ID NO: 227 - protein, 81 aa, Pan paniscus
FGNLLGVPWAQGNSALPEGLLSFKDISMEFTWDEWQLLDSTQKYLYRDVILENYHNLISVGYHGTKPDLIFKLEQGEDPWI

SEQ ID NO: 228 - protein, 81 aa, Pan paniscus
MSQGSVTFRDVAIDFSQEEWKWLQPAQRDLYRCVMLENYGHLVSLGLSISKPDVVSLLEQGKEPWLGKREVKRDLFSVSES

SEQ ID NO: 229 - protein, 81 aa, Pan paniscus
PAQGPGKARPSRKRGRRPRALKFVDVAVYFSPEEWGCLRPAQRALYRDVMRETYGHLGALGCAGPKPALISWLERNTDDWE

SEQ ID NO: 230 - protein, 81 aa, Pan paniscus
MAAMPLKAQYQEMVTFEDVAVHFTKTEWTGLSPAQRALYRSVMLENFGNLTALGYPVPKPALISLLEGGDMAWGLEAQDDP

SEQ ID NO: 231 - protein, 81 aa, Pan paniscus
MVTFEDVAVHFTKTEWTGLSPAQRALYRSVMLENFGNLTALGYPVPKPALISLLEGGDMAWGLEAQDDPPAERTKNVCKVI

SEQ ID NO: 232 - protein, 81 aa, Pan paniscus
CSHRSCREDPGTSESREMDPVAFDDVAVNFTQEEWALLDISQRKLYREVMLETFRNLTSIGKKWKDQNIEYEYQNPRRNFR

SEQ ID NO: 233 - protein, 81 aa, Pan paniscus
MDSVAFEDVAVNFTQEEWSLLDPSQKNLYREVMQETLRNLASIGEKWKDQYIEDQYKNPRNNLRSLLGERVDENTEENHCG

SEQ ID NO: 234 - protein, 81 aa, Pan paniscus
MDSVAFEDVAVSFTQEEWALLDPSQKNLYRDVMQETFKNLTSVGKTWKVQNIEDEYKNPRRNLRRSFTLVAQAGVRQDLGS

SEQ ID NO: 235 - protein, 81 aa, Pan paniscus
MDSVAFEDVAVNFTHEEWALLSPSQKNLYRDVMRETIRNLNCIGMKWENQNIDDQYQNLRRNPRCDVVERFGKSKDGSQCG

SEQ ID NO: 236 - protein, 81 aa, Pan paniscus
MGPLTFTDVAIEFSLEEWQCLDTAQQNLYRNVMLENYRNLVFLGIAVSKPDLITCLEKEKEPCKMKRHEMVDEPPDGVSLL

SEQ ID NO: 237 - protein, 81 aa, Pan paniscus
MGPLTIRDVTVEFSLEEWHCLDTAQQNLYRDVMLENYRNLVFLGIAVSKPDLITCLEQGKEPCNMKRHEMVAKPPVMCSHI

SEQ ID NO: 238 - protein, 81 aa, Pan paniscus
MSQVTFSDVAIDFSHEEWACLDSAQRDLYKDVMVQNYENLVSVGLSVTKPYVIMLLEDGKEPWMMEKKLSKDWESRWENKE

SEQ ID NO: 239 - protein, 81 aa, Pan paniscus
MALRSVMFSDVSIDFSPEEWEYLDLEQKDLYRDVMLENYSNLVSLAGCFISKPDVISSLEQGKEPWKVVRKGRRQYPDLET

SEQ ID NO: 240 - protein, 81 aa, Pan paniscus
MAHLMMFRDVAVDFSQEEWECLDLEQRGLYRDVMLENYSNMVSLGLCIYQPEAFSLLEKGKEPWKILRDETRGPCPDMQSR

SEQ ID NO: 241 - protein, 81 aa, Pan paniscus
MAEGLKFKDVVIYFSQKEWECLHSAQKDLYRDVMLENYGNLVLLGLSDTKPNVISLLEQKKEPWMVKRKETKEWCPDWEFG

SEQ ID NO: 242 - protein, 81 aa, Pan paniscus
TCMVHRQTMSCSGAGGITAFVAFRDVAVDFTQEEWRLLSPAQRTLHREVMLETYNHLVSLEIPSSKPKLIAQLERGEEPWR

SEQ ID NO: 243 - protein, 81 aa, Pan paniscus
MIEYQIPVSFKDVVVGFTQEEWHQLSPAQRALYRDVMLETYSNLVSVGYEGTKPDVILRLEQEEAPWIGEAACPGCHCWED

SEQ ID NO: 244 - protein, 81 aa, Pan paniscus
MIEYQIPVSFKDVVVGFTQEEWHQLSPAQRALYRDVMLETYSNLVSVGYEGTKPDVILRLEQEEAPWIGEAACPGCHCWGI

SEQ ID NO: 245 - protein, 81 aa, Pan paniscus
MIEYQIPVSFKDVVVGFTQEEWHQLSPAQRALYRDVMLETYSNLVSVGYEGTKPDVILRLEQEEAPWIGEAACPGCHCWGK

SEQ ID NO: 246 - protein, 81 aa, Pan paniscus
MVHGSVTFRDVAIDFSQEEWECLQPDQRTLYRDVMLENYSHLISLGSSISKPDVITLLEQEKEPWMVVRKETSRRYPDLES

SEQ ID NO: 247 - protein, 81 aa, Pan paniscus
MTKFQEAVTFKDVAVAFTEEELGLLDSAQRKLYRDVMLENFRNLVSVGHQSFKPDMISQLEREEKLWMKELQTQRGKHSGF

SEQ ID NO: 248 - protein, 81 aa, Pan paniscus
MIKFQMVTFKDVAVVFTEEELGLLDSVQRKLYRDVMLENFRNLLLVAHQPFKPDLISQLEREEKLLMVETETPGDGCSGRK

SEQ ID NO: 249 - protein, 81 aa, Pan paniscus
MAQCLVTFADVAIDFSQEEWACLNSAQRDLYWDVMLENYSNLVSLDLESAYENKSLPTEKNIHEIRASKRNSDRRSKSLGR

SEQ ID NO: 250 - protein, 81 aa, Pan paniscus
MSLGSELFRDVAIVFSQEEWQWLAPAQRDLYRDVMLETYSNLVSLGLAVSKPDVISFLEQGKEPWMVERVVSGGLCPGAKG

SEQ ID NO: 251 - protein, 81 aa, Pan paniscus
MSLGSELFRDVAIVFSQEEWQWLAPAQRDLYRDVMLETYSNLVSLGLAVSKPDVISFLEQGKEPWMVERVVSGGLCPVLES

SEQ ID NO: 252 - protein, 81 aa, Pan paniscus
MNVEVVKVMPQDLVTFKDVAIDFSQEEWQWMNPAQKRLYRSMMLENYQSLVSLGLCISKPYVISLLEQGREPWEMTSEMTR

SEQ ID NO: 253 - protein, 81 aa, Pan paniscus
DPAQVPVAADLLTDHEEQGYVTFEDVAVYFSQEEWRLLDDAQRLLYRNVMLENFTLLASLGLASSKTHEITQLESWEEPFM

SEQ ID NO: 254 - protein, 81 aa, Pan paniscus
GSLEEGRRATGLPAAQVQEPVTFKDVAVDFTQEEWGQLDLVQRTLYRDVMLETYGHLLSVGNQIAKPEVISLLEQGEEPWS

SEQ ID NO: 255 - protein, 81 aa, Pan paniscus
MAGEAEAQLDPSLQGLVMFEDVTVYFSREEWGLLNVTQKGLYRDVMLENFALVSSLGLAPSRSPVFTQLEDDEQSWVPSWV

SEQ ID NO: 256 - protein, 81 aa, Pan paniscus
MGPQGARRQAFLAFGDVTVDFTQKEWRLLSPAQRALYREVTLENYSHLVSLGILHSKPELIRRLEQGEAPWGEERRRRPGP

SEQ ID NO: 257 - protein, 81 aa, Pan paniscus
MFQTAWRQEPVTFEDVAVYFTQNEWASLDSVQRALYREVMLENYANVASLAFPFTTPVLVSQLEQGELPWGLDPWEPMGRE

SEQ ID NO: 258 - protein, 81 aa, Pan paniscus
MMTAVSLTTRPQESVAFEDVAVYFTTKEWAIMVPAERALYRDVMLENYEAVAFVVPPTSKPALVSHLEQGKESCFTQPQGV

SEQ ID NO: 259 - protein, 81 aa, Pan paniscus
MELLTFKDVAIEFSPEEWKCLDTSQQNLYRDVMLENYRNLVSLGVTISNPDLVTCLEQRKEPYNLKIHETAARPPGHYRKR

SEQ ID NO: 260 - protein, 81 aa, Pan paniscus
AETSSSGLLEEQKMMKSQGLVSFKDVAVDFTQEEWQQLDPSQRTLYRDVMLENYSHLVSMGYPVSKPDVISKLEQGEEPWI

SEQ ID NO: 261 - protein, 81 aa, Pan paniscus
MAAGQREARPQVSLTFEDVAVLFTRDEWRKLAPSQRNLYRDVMLENYRNLVSLGLPFTKPKVISLLQQGEDPWEVEKDGSG

SEQ ID NO: 262 - protein, 81 aa, Pan paniscus
GSQGNLPQAEITLMNQAQESVTFEDVAVNFTNREWQCLTYAQRHLYKDVMLENYGNMVSLGFPFPKPPLISHLEREVDPCV

SEQ ID NO: 263 - protein, 81 aa, Pan paniscus
AEITLMNQAQDSRSILFQESVTFEDVAVNFTNREWQCLTYAQRHLYKDVMLENYGNMVSLGFPFPKPPLISHLEREVDPCV

SEQ ID NO: 264 - protein, 81 aa, Pan paniscus
MDMAQEPVTFRDVAIYFSREEWACLEPSQRTLYRDVMLDNFSSVAALGFCSPRPDLVSRLEQWEEPWVEDRERPELQAVRR

SEQ ID NO: 265 - protein, 81 aa, Pan paniscus
MAALFLSAPPQAEVTFEDVAVYLSREEWGRLGPAQRGLYRDVMLETYGNLVSLGVGPAGPKPGVISQLERGDEPWVLDVQG

SEQ ID NO: 266 - protein, 81 aa, Pan paniscus
MPANEDAPQPGEHGSACEVSVSFEDVTVDFSREEWQQLDSTQRRLYQDVMLENYSHLLSVGFEVPKPEVIFKLEQGEGPWT

SEQ ID NO: 267 - protein, 81 aa, Pan troglodytes
MTLLTFRDVAIEFSLEEWKCLDLAQQNLYRDVMLENYRNLFSVGLTVSKPGLITCLEQRKEPWNVKRQEAADGHPGWSAVV

SEQ ID NO: 268 - protein, 81 aa, Pan troglodytes
MSQGSVTFRDVAIDFSQEEWKWLQPAQRDLYRCVMLENYGHLVSLGLSISKPDVVSLLEQGKEPWLGKREVKRDLFSGWSA

SEQ ID NO: 269 - protein, 81 aa, Pan troglodytes
MPLKAQYQEMVTFEDVAVHFTKTEWTGLSPAQRALYRSVMLENFGNLTALGYPVPKPALISLLEGGDMAWGLEAQDDPPAE

SEQ ID NO: 270 - protein, 81 aa, Pan troglodytes
MDTVVFEDVVVDFTPEEWALLNPAQRKLYRDVMLETFKHLASVDNEAQLKASGSISQQDTSGEKLSLKQKIEKFTRKNIWA

SEQ ID NO: 271 - protein, 81 aa, Pan troglodytes
CSHRSCREDPGTSESREMDPVAFKDVAVNFTQEEWALLDISQRKLYREVMLETFRNLTSIGKKWKDQNIEFEYQNPRRNFR

SEQ ID NO: 272 - protein, 81 aa, Pan troglodytes
DSVAFEDVAVNFTQEEWALLDPSQKNLYREVMQETLRNLTSIGKKWNNQYIEDEHQNPKRNLRRLIGERLSESKESHQHGE

SEQ ID NO: 273 - protein, 81 aa, Pan troglodytes
TCMVHRQTMSCSGAGGITAFVAFRDVAVDFTQEEWRLLSPAQRTLHREVMLETYNHLVSLEIPSSKPKLIAQLEQGEEPWR

SEQ ID NO: 274 - protein, 81 aa, Pan troglodytes
MMQAQESLTLEDVAVDFTWEEWQLLSPAQKDLYRDVMLENYSNLVSVGYQASKPDAFSKLERGEETCTTEDEIYSRICSEI

SEQ ID NO: 275 - protein, 81 aa, Pan troglodytes
MALTQGQLSFSDVAIEFSQEEWKCLDPGQKALYRDVMLENYRNLISLGICLPDLSVTSIFFTSGLGRARLQGGSLARVSRV

SEQ ID NO: 276 - protein, 81 aa, Pan troglodytes
MNNSQGRVTFEDVTVNFTQGEWQRLNPEQRNLYRDVMLENYSNLVSVGQRETTKPDVILRLEQGKEPWSEEEEVLGSGRAE

SEQ ID NO: 277 - protein, 81 aa, Pan troglodytes
MLPIVQLYPQGLVSFKDVAVDFTQEEWQQLDPSQRTLYRDVMLENYSHLVSMGYPVSKPDVISKLEQGEEPWIIKGDISNW

SEQ ID NO: 278 - protein, 81 aa, Pan troglodytes
ADITLMSQAQDSRSILFQESVTFEDVAVNFTNREWQCLTYAQRHLYKDVMLENYGNMVSLGFPFPKPPLISHLEREVDPCV

SEQ ID NO: 279 - protein, 81 aa, Pan troglodytes
MRVLTFRDVAVEFSPEEWECLDSAQQHLYRDVMLENYGNLFSLGLAIFKPDLITYLEQRKEPWNARRQKTVAKHPAGSLHF

SEQ ID NO: 280 - protein, 81 aa, Gorilla sp.
MHLTAWPQKSVTFEDVAVYFTQAEWDGLSPAQRALYRDVMLENYGNVASLGFPLLKPAVISQLEGGGELGGPSPLAAGTGL

SEQ ID NO: 281 - protein, 81 aa, Gorilla sp.
MAAMPLKARYQEMVTFEDVAVHFTKTEWTGLSPAQRALYRSVMLENFGNLTALGYPVPKPALISLLEGGDMAWGLEAQDDP

SEQ ID NO: 282 - protein, 81 aa, Gorilla sp.
MPLKARYQEMVTFEDVAVHFTKTEWTGLSPAQRALYRSVMLENFGNLTALGYPVPKPALISLLEGGDMAWGLEAQDDPPAE

SEQ ID NO: 283 - protein, 81 aa, Gorilla sp.
MGPLQFKDVAIEFSLEEWHCLDTAQRNLYRDVMLENYRNLVFLGIVVSKPDLIARLEQGKKPLTMKRHEMVANPSGPGVVV

SEQ ID NO: 284 - protein, 81 aa, Gorilla sp.
EELVGQNHGMEGEACTGGDVTFSDVAIDFSHEEWACLDTAQRDLYKDVMVQNYENLVSVGLSVTKPYVIMLLEDGKEPWMM

SEQ ID NO: 285 - protein, 81 aa, Gorilla sp.
MIEYQIPVSFKDVVVGFTQEEWHRLSPAQRALYRDVMLETYSNLVSVGYEGTKPDVILRLEQEEAPWIGEAACPGCHCWGK

SEQ ID NO: 286 - protein, 81 aa, Gorilla sp.
MNMEGLVMFQDLSIDFSQEEWECLDAAQKDLYRDVMMENYSSLVSLGLSIPKPDVISLLEQGKEPWMVSRDVLGGWCRGLE

SEQ ID NO: 287 - protein, 81 aa, Gorilla sp.
LAPEDHGSSYEGSVSFRDVAIDFSREEWRHLDPSQRNLYRDVMLETYSHLLSVGYQVPEAEVVMLEQGKEPWALQGERPRQ

SEQ ID NO: 288 - protein, 81 aa, Gorilla sp.
MVHGSVTFRDVAIDFSQEEWECLQPDQRTLYRDVMLENYSHLISLAGSSISKPGVITLLEQEKEPWMVVRKETSRWYPDLE

SEQ ID NO: 289 - protein, 81 aa, Gorilla sp.
MTKFQEAVTFKDVAVAFTEEELGLLDSAQRKLYRDVMLENFRNLVSVGHQSFKPDVISQLEREEKLWMKELQTQRGKHSET

SEQ ID NO: 290 - protein, 81 aa, Gorilla sp.
MLQTVWFQEPVTFEDVAVYFTQNEWASLHPTQRALYREVMLENYANVTSLSAFPFPKPDLIFQLEQGEAAWGPDPWTLAGG

SEQ ID NO: 291 - protein, 81 aa, Gorilla sp.
MELLTFRDVAIEFSPEEWKCLDPDQQNLYRDVMLENYRNLVSLGVAISNPDLVTCLEQRKEPYNVKIHKIVARPPAVCSHS

SEQ ID NO: 292 - protein, 81 aa, Gorilla sp.
MAAGQREARPQVSLTFEDVAVLFTRDEWRKLAPSQRNLYRDVMLENYRNLLSLGLPFTKPQVISLLQQGEDPWEVEKEGSG

SEQ ID NO: 293 - protein, 81 aa, Gorilla sp.
MAVDLLSAQERVTFRDVAVFFSQDEWLHLDSAQRALYREVMLENYSILVSLGIPFSMPKLIHQLQQGEDPCMVEREVPSDT

SEQ ID NO: 294 - protein, 81 aa, Gorilla sp.
MDMAQEPVTFRDVAIYFSREEWACLEPSQRALYRDVMLDNFSSVAALGFCSPRPDLVSRLEQWEEPWVEDWERPELQAVQR

SEQ ID NO: 295 - protein, 81 aa, Gorilla sp.
MAALFLSAPHQAKVTFEDVAVYLSREEWGRLGPAQRGLYRDVMLETYGNLVSLGVGPAGPKPGVISQLERGDEPWVLDVQG

SEQ ID NO: 296 - protein, 81 aa, Gorilla sp.
MAMSQESLTFKDVFVDFTLEEWQQLDSAQKNLYRDVMLENYSHLVSVGYLVEKPDVIFRLGPGEESWMADGGTPVRTCAGE

SEQ ID NO: 297 - protein, 81 aa, Pongo sp.
GESLESRVTLGSLTAESQELLTFKDVSVDFTQEEWGQLAPAHRNLYREVMLENYGNLVSVGYQLSKPGVISQLEKGEEPWL

SEQ ID NO: 298 - protein, 81 aa, Pongo sp.
MANATGSGVEQKFQGSVSFKDVTVGFTQEEWQHLDPSQRALYRDVMLENYSNLVSVGYCVHKPEVIFRLEQGEEPWKLEEE

SEQ ID NO: 299 - protein, 81 aa, Pongo sp.
MTLLTFRDVAIEFSLEEWKCLDLAQQNLYRDVMLENYRNLFSIGLTVSKPGLITCLEQRKEPWNVKRQEAVDGHPGWCSGV

SEQ ID NO: 300 - protein, 81 aa, Pongo sp.
MSQGLVTFRDVAIDFSQEEWKWLQPAQRDLYRCVMLENYGHLVSLGLSISKPDVVSLLEQGKEPWLGKREVKRDLFSVSES

SEQ ID NO: 301 - protein, 81 aa, Pongo sp.
APLLAPRPGETRPGCRKPGAVSFADVAVYFSPEEWGCLRPAQRALYRDVMRETYGHLGALGFPGPKPALISWMEQESEAWS

SEQ ID NO: 302 - protein, 81 aa, Pongo sp.
MHLTAWPQKSVTFEDVAVYFTQAEWDGLSPAQRTLYRDVMLENYGNVASLGFPLLKPAVISQLEGGGELGGPSPLAAGRGL

SEQ ID NO: 303 - protein, 81 aa, Pongo sp.
MGPLQFRDVAIEFSLEEWHCLDTTQRNLYRDVMLENYRNLVFLGIVVSKPDLITCLEQGKKPLTMKRHEMIAKPPGQAQWL

SEQ ID NO: 304 - protein, 81 aa, Pongo sp.
MSQVTFSDVAIDFSHEEWACLDSAQRDLYKDVMVQNYENLVSVGLSITKPYVIMLLEDGKEPWMMEKKLSKVYPFPLSHSV

SEQ ID NO: 305 - protein, 81 aa, Pongo sp.
MAQGLVTFRDVAIEFSLEEWKCLEPAQRDLYREVTLENFGHLASLGLSISKPDVVSLLEQGKEPWMIANDVTGPWYPDLES

SEQ ID NO: 306 - protein, 81 aa, Pongo sp.
MAQESVMFSDVSVDFSQEEWECLNDDQRDLYRDVMLENYSNLVSMAGHSVSKPNVISYLEQGKEPWLVDRELTRGQWPVLE

SEQ ID NO: 307 - protein, 81 aa, Pongo sp.
MAHLMMFRDVAVDFSQEEWECLDLEQRDLYRDVMLENYSNMVSLGLCIYQPEAFSLLEKGKDPWKILRDETRRPCPDMQSR

SEQ ID NO: 308 - protein, 81 aa, Pongo sp.
LAPDDHGSSYEGSVSFRDVAIDFSREEWRHLDPSQRNLYRDVMLETYSHLLSVGYQVPEAEVVMLEQGKEPWALQGERPRH

SEQ ID NO: 309 - protein, 81 aa, Pongo sp.
HRVGLIRSYNSKTMTCFQELVTFRDVAIDFSRQEWEYLDPNQRDLYRDVMLENYRNLVSLGGHSISKPVVVDLLERGKEPW

SEQ ID NO: 310 - protein, 81 aa, Pongo sp.
EETQGELTSSCGSKTMANVSLAFRDVSIDLSQEEWECLDPVQRDLYKDVMLENYSNLVSLGYTIPKPDVITLLEQEKEPWI

SEQ ID NO: 311 - protein, 81 aa, Pongo sp.
MTKAQESLTLKDVAVDFTWEEWQLLGPAQKRLYRDVMLENYSNLVSVGYQASKPDALTKLEQGEPLWTLEDEIHSPAHPEI

SEQ ID NO: 312 - protein, 81 aa, Pongo sp.
MINAQELLTLEDVTVEFTWEEWQLLDPFQKDLYRDVTLEIYSNLVSMGYQVSKPDALSKLEQGEEPWTMEDERHSRICPGT

SEQ ID NO: 313 - protein, 81 aa, Pongo sp.
EGEAQKRKAEESGMPLTQGHLTFRDVAIEFSQEEWKCLDPVQKALYRDVMLENYRNLVSLGICLPDLSIFSMMKQRTESWT

SEQ ID NO: 314 - protein, 81 aa, Pongo sp.
MNVEVVKVMPQDLVTFKDVAIDFSQEEWQWMNPAQKCLYRSMMLENYQSLVSLGLCISKPYVISLLEQGREPWEMTSEMTR

SEQ ID NO: 315 - protein, 81 aa, Pongo sp.
MNSEVIVDPIQGQVNFEDVFVYFSQEEWVLLDEAQRLLYRDVMLENFALMASLGHTSFMSHIGASLVMGSEPWVPDWVDMI

SEQ ID NO: 316 - protein, 81 aa, Pongo sp.
MGPQGARRQAFLAFGDVTVDFTQKEWRLLSPTQRALYREVTLENYSHLVSLGILHSKPELIRRLEQGEAPWGEERRRRPGP

SEQ ID NO: 317 - protein, 81 aa, Pongo sp.
MAAVSPTTRCQESVTFEDVAVVFTDEEWSHLVPTQRDLYKEVMLENYNSIVSLGLPVPQPDVIFQLKRGDKPWMVDLHGSE

SEQ ID NO: 318 - protein, 81 aa, Pongo sp.
MMTAVSLTTRPQESVAFEDVAVYFTTKEWAIMVPAERALYRDVMLENYEAVAFVVSPTSKPALVSHLEQGKESCFTRPQGV

SEQ ID NO: 319 - protein, 81 aa, Pongo sp.
MFPPARGKELLSFEDVAMYFTREEWGHLSWGQKDLYRDVMLENYRNMVLLGFQFPKPEVICQLENWDEQWILDLPRAGNRK

SEQ ID NO: 320 - protein, 81 aa, Pongo sp.
QDPSAEGLSEEVPVVFEELPVVFEDVAVYFTREEWGMLDKWQKELYRDVMRMNYELLASLGPAAAKPDLISKLERRAAPWI

SEQ ID NO: 321 - protein, 81 aa, Hylobates sp.
MAAGQREARPQVSLTFEDVAVLFTRDEWRKLAPSQRNLYRDVMLENYRNLVSLGLPFTKPKVISLLQQGEDPWKVEKDSSG

SEQ ID NO: 322 - protein, 81 aa, Hylobates sp.
MAGEAEAQLDPSLQGLVMFEDVTVYFSREEWGLLNVTQKGLYRDVMLENFALVSSLGLAPSRSPVFTQLEDDEQSWVPNWV

SEQ ID NO: 323 - protein, 81 aa, Hylobates sp.
MAAAAALRAHAQSSVTFEDVAVNFSMEEWSLLNEAQRCLYRDVMLETLTLISSLGCWHGGEDEAAPSKQSTCIYIYKEQGG

SEQ ID NO: 324 - protein, 81 aa, Hylobates sp.
MAAAALVNTPQGHVTFEDIAVYFSQEEWGLLDEAQRCLYHDVMLENFSLMASVGCLHGIEAEEAPSEQTVSAQGASQARTP

SEQ ID NO: 325 - protein, 81 aa, Hylobates sp.
MAAAALRDPAQQGYVTFEDVAVYFSQEEWRLLDEAQKLLYRNVMLENFSLLASLGLASSKTHEITQLESWEEPFMPAWEVV

SEQ ID NO: 326 - protein, 81 aa, Hylobates sp.
MAAAALRDPAQQGYVTFEDVAVYFSQEEWRLLDEAQKLLYRNVMLENFSLLASLGLASSKTHEITQLESWEEPFMPAWEAV

SEQ ID NO: 327 - protein, 81 aa, Hylobates sp.
MSLGSELFRDVAIVFSQEEWQWLAPAQRDLYRDVMLETYSNLVSLGLAISKPDVISFLEQGKEPWMVERVVSRGLCPVLES

SEQ ID NO: 328 - protein, 81 aa, Hylobates sp.
MALRSVMFSDVSIDFSPEEWEYLDLEQKDLYRDVMLENYSNLVSLGCFISKPDVISLLEQGKEPWKVVRKGRRQYPDLETR

SEQ ID NO: 329 - protein, 81 aa, Hylobates sp.
MGLLTFRDVAIEFSLEEWQCLDTAQKNLYRNVMLENYRNLAFLGIAVSKPDLIICLEKEKEPWNMKRHEMVDEPPGLAVSN

SEQ ID NO: 330 - protein, 81 aa, Hylobates sp.
MEPLKFRDVAIEFSLEEWQCLDSIQQNLYRNVMLENYRNLVFLGIAASKPDLIICLEQEKEPWSRKRRRMVAELPVICSHF

SEQ ID NO: 331 - protein, 81 aa, Hylobates sp.
MGLLTFRDVAIEFSLEEWQCLDTAQQNLYRNVMLENYRNLAFLGIAVSKPDLITCLEQGKEPWNMKRHEMVDEPPGVCPHF

SEQ ID NO: 332 - protein, 81 aa, Hylobates sp.
MSGPPGSLEMEPLQFRDVAVEFSLEEWHCLDTAQQNLYRDVMLENYRHLVFLGIVVSKPDLITCLEQGKKPLTMKRHEMIA

SEQ ID NO: 333 - protein, 81 aa, Hylobates sp.
MGPLQFRDVAIEFSLEEWHCLDTAQRNLYRNVMLENYSNLVFLGIVVSKPDLITRLEQGKKPLTMKRHEMVANPSGPGVFV

SEQ ID NO: 334 - protein, 81 aa, Hylobates sp.
MMFQDSVAFEDVAVTFTQEEWALLDPSQKNLYRDVMQETFKNLASIGKKWKAQNIYVEYKNLRRNLRIVGERLFESKEGHQ

SEQ ID NO: 335 - protein, 81 aa, Hylobates sp.
MDSVAFEDVAINFTCEEWALLGPSQKSLYRDVMQETIRNLDCIGMTWQTHDIEEDQYKDLRRNLRCHMVERSCEIKDNSQC

SEQ ID NO: 336 - protein, 81 aa, Hylobates sp.
MIKSQESLTLEDVAVEFTWEEWQLLGPAQKDLYRDVMLENYSNLVSVGYQASKPDALFKLEQGEPWTVENDSHICPEIKKV

SEQ ID NO: 337 - protein, 81 aa, Hylobates sp.
MMQAQESLTLEDVAVDFTWEEWQFLSPAQKDLYRDVMLENYSNLVAVGYQARKPDALSKLERGEEPCTTEDEIYARICSDS

SEQ ID NO: 338 - protein, 81 aa, Hylobates sp.
MESLTLEDVAVDFTWEEWQFLSPAQKDLYRDVMLENYSNLVAVGYQARKPDALSKLERGEEPCTTEDEIYARICSDSGGAS

SEQ ID NO: 339 - protein, 81 aa, Hylobates sp.
MINAQELLTLEDVTVEFTWEEWQLLDPFQKDLYRDVMLEIYSNLVSIGYQVSKPDALSKLERGEEPWTVEDERHSQICPEN

SEQ ID NO: 340 - protein, 81 aa, Hylobates sp.
MSQGSVTFRDVAIDFSQEEWKWLQPAQRDLYRCVMLENYGHLVSLGLSISKPDVVSLLEQGKEPWLGKRDVKRDLFSVLKE

SEQ ID NO: 341 - protein, 81 aa, Hylobates sp.
MAHALVTFRDVAIDFSQKEWECLDTTQRKLYRDVMLENYNNLVSLGYSGSKPDVITLLEQGKEPCMAARDVTGRQYPGLLS

SEQ ID NO: 342 - protein, 81 aa, Hylobates sp.
MIEYQIPVSFKDVVVGFTQEEWHQLSPAQRALYRDVMLETYSNLVSVGYEGTKPDVILRLEQEEAPWIGEAACLGCHCWED

SEQ ID NO: 343 - protein, 81 aa, Hylobates sp.
MIEYQIPVSFKDVVVGFTQEEWHQLSPAQRALYRDVMLETYSNLVSVGYEGTKPDVILRLEQEEAPWIGEAACLGCHCWGI

SEQ ID NO: 344 - protein, 81 aa, Hylobates sp.
MIEYQIPVSFKDVVVGFTQEEWHQLSPAQRALYRDVMLETYSNLVSVGYEGTKPDVILRLEQEEAPWIGEAACLGCHCWGK

SEQ ID NO: 345 - protein, 81 aa, Hylobates sp.
LAPEDHGSSYEGSVSFRDVAIDFSREEWRHLDLSQRNLYRDVMLETYSHLLSVGYQVPEAEVVMLEQGKEPWALQGERPRH

SEQ ID NO: 346 - protein, 81 aa, Hylobates sp.
MNMEGLVMFQDLSIDFSQEEWECLDAAQKDLYRDVMMENYSSLVSLGLSIPKPDVISLLEQGKEPWMVSRDMLGGWCPDSE

SEQ ID NO: 347 - protein, 81 aa, Hylobates sp.
TQPDEDLHLQVEETQLVKESVTFKDVAIDFTLEEWRLMDPTQRNLHKDVMLENYRNLVSLGLAVSKPDMISHLENGKGPWV

SEQ ID NO: 348 - protein, 81 aa, Hylobates sp.
MGLVSFKDVAVDFTQEEWQQLDPSQRTLYRDVMLENYSHLVSMGYPVSKPDVISKLEQGEEPWIIKGDISNWIYPDEYQAD

SEQ ID NO: 349 - protein, 81 aa, Hylobates sp.
IHLTAWPQKSVTFEDVAVYFTQAEWDGLSPAQRTLYRDVMLENYGNVASLGFPLLKPAVISQLEGGGDLGGPSPLAAGTGL

SEQ ID NO: 350 - protein, 81 aa, Hylobates sp.
MAAMPLKARYQEMVTFEDVAVHFTKTEWTGLSPAQRALYRSVMLENFGNLTALGYPVPKPALISLLEGGDMDWGLEAQDDP

SEQ ID NO: 351 - protein, 81 aa, Hylobates sp.
MVTFEDVAVHFTKTEWTGLSPAQRALYRSVMLENFGNLTALGYPVPKPALISLLEGGDMDWGLEAQDDPPAERTKNVCKVI

SEQ ID NO: 352 - protein, 81 aa, Hylobates sp.
MPLKARYQEMVTFEDVAVHFTKTEWTGLSPAQRALYRSVMLENFGNLTALGYPVPKPALISLLEGGDMDWGLEAQDDPPAE

SEQ ID NO: 353 - protein, 81 aa, Hylobates sp.
PAQGPGEARPSRKRGRRPRALKFVDVAVYFSPEEWGCLRPAQRALYRDVMRETYGHLGALGCAGPKPALISWLERNTDDWE

SEQ ID NO: 354 - protein, 81 aa, Hylobates sp.
ADITLMSQAQDSRSILFQESVTFEDVAVNFTNREWQCLTYAQRHLYKDVMLENYRNMASLGFPFPKPPLISHLEREVDPCV

SEQ ID NO: 355 - protein, 81 aa, Hylobates sp.
MPGPPGSLEMGVLTFRDVAIEFSLEEWQCLDITQQNLYRNVMLENYRNLVFVGIAASKPDLITCLEQGKEPWNVKRHEMVA

SEQ ID NO: 356 - protein, 81 aa, Hylobates sp.
MMTAVSLTTRPQESVAFEDVAVYFTAKEWDIMVPAERALYRDVMLENYEAVAFVVPPTSKPALVSHLEQGKESCFTRPQGV

SEQ ID NO: 357 - protein, 81 aa, Macaca mulatta
MAHMAFRDVAVDFTQDEWRLLSPAQRTLYREVMLENYSNLVSLGISFSKPELITQLEQGKETWREEKNCSPATCPADPEPE

SEQ ID NO: 358 - protein, 81 aa, Macaca mulatta
MSQGSVTFRDVAIDFSQEEWKWLQPAQRDLYRCVMLENYGHLVSLGLSISKPDVVSLLEQGKEPWLGKRNVNRDLFSVSES

SEQ ID NO: 359 - protein, 81 aa, Macaca mulatta
MAAVSPTTRCQESVTFEDVAVVFTDEEWSHLVPIQRDLYKEVMLENYNSIVSLGLPVPQPDVIFQLKRGDKPWVVDLHGSE

SEQ ID NO: 360 - protein, 81 aa, Macaca mulatta
TLLTFRDVAIEFSLEEWKCLDPAQQNLYRDVMLENYRNLFSIGLTVSKPGLITCLEQRKEPWNVKRQEAVDGHPAMSSHVT

SEQ ID NO: 361 - protein, 81 aa, Macaca mulatta
MAPGLLTTREEALMAFRDVAVAFTQKEWKLLSSAQRTLYREVMLENYSHLVSLGIAFSKPKLIEQLEQGNEPWREENEHLL

SEQ ID NO: 362 - protein, 81 aa, Macaca mulatta
MDSVAFEDVAVTFTQEEWALLDPSQKTLYRDVMQETFRNLASVGKKWKAQNMYVEYENLKRNLRTFVGERLFESKEGHQHG

SEQ ID NO: 363 - protein, 81 aa, Macaca mulatta
MDSVAFEDVAVNFTQEEWALLSPSQKNLYRDVMLEAFRNLASVGIQWKDQDTENLYQNLGIKLRHMRAHAGHTRSECGGEW

SEQ ID NO: 364 - protein, 81 aa, Macaca mulatta
MGLLTFRDVAIEFSLEEWQCLDTAQKNLYRNVMLENYRNLAFLGVAVSKPDLIICLEKDKEPWNMKRHEMVDEPPGLTVSN

SEQ ID NO: 365 - protein, 81 aa, Macaca mulatta
MEPLKFRDVAVEFSLEEWQCLDTIQQNLYRNVMLENYRNLVFLGIAVSKPDLITCLEQEKEPWTRKRHRMVAKPVTCSHFA

SEQ ID NO: 366 - protein, 81 aa, Macaca mulatta
MAHFQGSVTFEDVAIAFSQQEWESLDSSQRGLYRDVMLENYRNLVSMGHSLSKPHVIALLERWKEPKVTERKDGRRWCTDL

SEQ ID NO: 367 - protein, 81 aa, Macaca mulatta
MAHFQGSVTFEDVAIAFSQQEWESLDSSQRGLYRDVMLENYRNLVSMAGHSLSKPHVIALLERWKEPKVTERKDGRRWCTD

SEQ ID NO: 368 - protein, 81 aa, Macaca mulatta
MNMEGLVMFQDLFIHFSQEEWECLDAAQKDLYRDVMMENYSSLVSLGLCIPKPDVISLLEQGKEPWMVSRDVLGGWCPDSE

SEQ ID NO: 369 - protein, 81 aa, Macaca mulatta
TMSCSRAGGITGCIKYSTASVAFRDVAVDFTQEEWRLLSPAQRTLHREVMLETYNHLVSLEIPSSKPKLIAQLERGEEPWR

SEQ ID NO: 370 - protein, 81 aa, Macaca mulatta
MSLGSELFRDVAIVFSQEEWQCLAPAQRDLYRDVMLETYNNLVSLGLAISKPDVISFLEQGKEPWMVERVVSGGLCPVLES

SEQ ID NO: 371 - protein, 81 aa, Macaca mulatta
MNVEVVKVMPQDLVTFKDVAIDFSQEEWQWMNPAQKHLYRSMMLENYQSLVSLGLCISKPCVISLLEQGREPWEMTSEMTR

SEQ ID NO: 372 - protein, 81 aa, Macaca mulatta
MATALTDPAQVSVTFDDVAVTFTQEEWGQLDLAQRTLYQEVMLENCGLLVSLGCPVPRPELIYHLEHGQEPWTRKEDLSQD

SEQ ID NO: 373 - protein, 81 aa, Macaca mulatta
MAFEDVAVYFSQEEWGLLDTAQRALYRHVMLENFTLVTSLGLSTSRPHVVIQLERGEEPWVPSGKDMTLARNTYRRLNAGS

SEQ ID NO: 374 - protein, 81 aa, Macaca mulatta
MAFEDVAVYFSQEEWGLLDTAQRALYRRVMLDNFALVASLGLSTSRPRVVIQLERGEEPWVPSGTDTILSRNTYRRRNPGS

SEQ ID NO: 375 - protein, 81 aa, Macaca mulatta
MLQTAWRQEPVTFEDVAVYFTQNEWASLDSVQRALYREVMLENYANVASLAFPFTTPVLVSQLEQGELPWGLDPWEPMGRE

SEQ ID NO: 376 - protein, 81 aa, Macaca mulatta
MMTAVSLTTRSQESVAFEDVAVYFTTKEWAIMVPAERALYRDVMLENYEAVAFVVPPTSKPALVSHLEQGKESCFIRPQGV

SEQ ID NO: 377 - protein, 81 aa, Macaca mulatta
MVTFEDVAVHFTKTEWTGLSPAQRALYRSVMLENFGNLTALGYPVPKPALISLLEGGDMAWGLEAQDDAPAERTKNICKGR

SEQ ID NO: 378 - protein, 81 aa, Macaca mulatta
MVTFEDVAVHFTKTEWTGLSPAQRALYRSVMLENFGNLTALGYPVPKPALISLLEGGDMAWGLEAQDDAPAERTKNICKVI

SEQ ID NO: 379 - protein, 81 aa, Macaca mulatta
MELLSFEDVAMYFTREEWGHLDWGQKDLYRDVMLENYRNMVLLGFQFPKPEVICQLENWDEQWILDLPRAGSRKASGSACP

SEQ ID NO: 380 - protein, 81 aa, Macaca mulatta
QDPSAEGLSEEVPVVFEELPVVFEDVAVYFTRKEWGMLDKRQKELYRDVMRMNYELLASLGPAAAKPDLISKLERRAAPWI

SEQ ID NO: 381 - protein, 81 aa, Callithrix sp.
PVRGPGEARPSRKRGRRPRALKFVDVAVYFSSEEWGCLRPAQRALYRDVMRETYGHLGALGCAGPKPALISWLERNTDDWE

SEQ ID NO: 382 - protein, 81 aa, Callithrix sp.
TMTTVSSTARPQESVAFDDVAVYFTKKEWAIMVPDQRALYRDVMLENYEAVAFVVPPTSKPALISHLEQGKEPCFTQPQGV

SEQ ID NO: 383 - protein, 81 aa, Callithrix sp.
MLQTAWRQEPVTFEDVAVYFTQNEWTSLDPVQRALYREVMLENYANVASLAFPFTTPVLVSQLEQGERPWGLDPWEPVGRE

SEQ ID NO: 384 - protein, 81 aa, Callithrix sp.
MLQTAWPQRLSRNLWFQESVAFEDVAVYFTQNQWASLDPAQRALYREVMLENYANVTSLVAFPFPKPALISHLEKGEAPWG

SEQ ID NO: 385 - protein, 81 aa, Callithrix sp.
MAAGQPEARPQVSLTFEDVAVLFTRDEWRKLAPSQRNLYRDVMLENYRNLVSLGLPFTKPKVISLLQQGEDPWKVEKDCFG

SEQ ID NO: 386 - protein, 81 aa, Callithrix sp.
MAAIPLKAQCQETVTFEDVAVHFTKTEWTGLSPAQRALYRSVMLENYGNLTAMGYLVPKPALISLLEGGDMAWGLEAQDDP

SEQ ID NO: 387 - protein, 81 aa, Callithrix sp.
CFSGEERMAAGHPPRWPQELVTFEDVSVDFSQEEWELLDPAQKELYREVTLENYRNLVSLEALKNPCADAGMEEGPFSTAH

SEQ ID NO: 388 - protein, 81 aa, Callithrix sp.
MFQDSVAFEDVAVTFTQEEWALLDPSQKTLYRDVMQENFRNLASVGKKWKAQNIYVEYKNLRRNLRNLMGKRLFESKEDHQ

SEQ ID NO: 389 - protein, 81 aa, Callithrix sp.
DSVAFEDVAVNFTQEEWALLDRSQKKLYREVMQETLRNLTSIGKTWSNQNAEERHQNPRRNLRRLIGERLFQSKESHQHAE

SEQ ID NO: 390 - protein, 81 aa, Callithrix sp.
MDTVALEDVAVNFTQEEWALLGPSQKKLYRDVMQETIRNLDCIKMISEDQNIEDQYKNPKKNLRCRMAERLSESKDNSQCG

SEQ ID NO: 391 - protein, 81 aa, Callithrix sp.
MTPGPPGSLEMEPLTFKDVAIEFCLEEWQCLDTAQQDLYRNVMLENYRNLVFLGIAVSKPDLITCLEQGKVPWNRKRHEMV

SEQ ID NO: 392 - protein, 81 aa, Callithrix sp.
MNMEGLVMFQDLSIDFSQEEWECLNPAQKDLYRDVMMENYSSLLSLGLSIPKPDVISLLEQGKEPWMVSRDILGGWCPDRL

SEQ ID NO: 393 - protein, 81 aa, Callithrix sp.
MALRSVIFSDISIDFSPEEWEYLDLEQKDLYRDVMLENYSNLVSLGCFISKPDVISLLEQGKEPWKVVRKRRRQYPDLETK

SEQ ID NO: 394 - protein, 81 aa, Callithrix sp.
MINYQTPVSFRDVVVGFTQEEWHRLNPTQRALYRDVMLETYSNLVSVGYEGTKPDVILRLEQEEAPWIGEAACLGCHCWED

SEQ ID NO: 395 - protein, 81 aa, Callithrix sp.
MINYQTPVSFRDVVVGFTQEEWHRLNPTQRALYRDVMLETYSNLVSVGYEGTKPDVILRLEQEEAPWIGEAACLGCHCWGI

SEQ ID NO: 396 - protein, 81 aa, Callithrix sp.
MINYQTPVSFRDVVVGFTQEEWHRLNPTQRALYRDVMLETYSNLVSVGYEGTKPDVILRLEQEEAPWIGEAACLGCHCWGK

SEQ ID NO: 397 - protein, 81 aa, Callithrix sp.
HGSSYEGSVSFRDVAINFSREEWRHLDLSQRNLYWDVMLETYSHLLSVGYQFPKPEVVMLEQGNEPWALQGERPRHSCPGE

SEQ ID NO: 398 - protein, 81 aa, Callithrix sp.
MTTLKETVTFKDVAVVFTEEELQLLDPAQKKLYQDVMLENFRNLLSVGHQPFHGDTFHFPREEKFWMVETATQKEGNLDGV

SEQ ID NO: 399 - protein, 81 aa, Callithrix sp.
MALTQGQVTFRDVAIEFSQEEWTCLDPAQRSLYRDVMLENYRNLASLGISCFDLSIISMLEQGKGPFALESQVQRAGNPDG

SEQ ID NO: 400 - protein, 81 aa, Callithrix sp.
MPLGSELFRDVAIVFSQEEWQWLAPAQRDLYRDVMLETYSNLVSLGLAISKPDVISFLEQGKEPWMVERVVAGGLCPEAEL

SEQ ID NO: 401 - protein, 81 aa, Callithrix sp.
MPLGSELFRDVAIVFSQEEWQWLAPAQRDLYRDVMLETYSNLVSLGLAISKPDVISFLEQGKEPWMVERVVAGGLCPVLES

SEQ ID NO: 402 - protein, 81 aa, Callithrix sp.
MAAAALRLPAQGTVTFEDVAVKFSQEEWSILTEAQRCLYHDVMLENLALISSLGCWYGAKDETPSKQTLSIQQQSPLRSHW

SEQ ID NO: 403 - protein, 81 aa, Callithrix sp.
MAFEDVAVYFSEEEWGLLDTAQRALYRHVMLENFTLVTSLGLSTSRPLVVIQLERGEDPWVPSVKDMTLARNAYGRRTTGS

SEQ ID NO: 404 - protein, 81 aa, Callithrix sp.
MAFEDVAVYFSQEEWGLLDTAQRALYRRVMLDNFALVASLGLSTSRPRVVIQLERGEEPWVPSETDMTMSRNTHRRRNPGS

SEQ ID NO: 405 - protein, 81 aa, Callithrix sp.
MAFRDVAVDFTQDEWRLLSPAQRTLYREVMLENYSNLVSLGISFSKPEIITQLEQGKETWREEKKCPPATCPADPEPELCL

SEQ ID NO: 406 - protein, 81 aa, Callithrix sp.
MAHMAFRDVAVDFTQDEWRLLSPAQRTLYREVMLENYSNLVSLGISFSKPEIITQLEQGKETWREEKKCPPATCPDPEPEL

SEQ ID NO: 407 - protein, 81 aa, Callithrix sp.
GENLESRVTLGSPAAESQELLTFKDVSVDFTQEEWGQLAPAHRNLYREVMLENYGNLVSVGYQLSKPGLISQLEKGEEPWL

SEQ ID NO: 408 - protein, 81 aa, Callithrix sp.
MTMLQDSFSFDDLSVDFTQKEWQLLDPSQKNLYKDVMLENYSSLVSLGYEAMKPDVIFKLEQGEEPWIGDEEIPSSWSPDI

SEQ ID NO: 409 - protein, 81 aa, Callithrix sp.
MSQGSVTFRDVAIDFSQEEWKWLQPAQRDLYRCVMLENYGHLVSLGLSISKPDVVSLLEQGKEPWLGKRDVKRDLFPVSES

SEQ ID NO: 410 - protein, 81 aa, Callithrix sp.
MSQGSVTFRDVAIDFSQEEWKWLQPAQRDLYRCVMLENYGHLVSLGLSISKPDVVSLLEQGKEPWLGKRDVKRDLFPVLKE

SEQ ID NO: 411 - protein, 81 aa, Callithrix sp.
IREFGGMGAGIANIWSFQGSVTFRDVAIDFSQEEWKWLQPAQRDLYRCVMLENYGHLVSLGLSISKPDVVSLLEQGKEPWL

SEQ ID NO: 412 - protein, 81 aa, Callithrix sp.
MPANEDTPQPGGHGSACEVSVSFEDVTVDFSREEWQQLDSTQRRLYQDVMLENYSHLLSVGFEVPKPEVIFKLEQGEGPWT

SEQ ID NO: 413 - protein, 81 aa, Aotus trivirgatus
MITAQGPVSFRDVTVGFTQEEWQHLDPAQRTLYRDVMIENYSHLVSVGYCIPKPEVILKLEKGEEPWISEEKFPSQSHLEL

SEQ ID NO: 414 - protein, 81 aa, Aotus trivirgatus
MHLTAWPQKSVTFEDVAVYFTQAEWDGLSPAQRTLYRDVMLENYGNVASLGFPLLKPAVISQLEGGGELGGPSPLAAGTGL

SEQ ID NO: 415 - protein, 81 aa, Aotus trivirgatus
MAHMAFRDVAVDFTQDEWRLLSPAQRTLYREVMLENYSNLVSLGISFSKPEIITQLEQGKETWREEKKCPPATCPADPEPE

SEQ ID NO: 416 - protein, 81 aa, Aotus trivirgatus
MNMEGLVMFQDLSIDFSQEEWECLNPTQKDLYRDVMMENYSSLLSLGLSIPKPDVISLLEQGKEPWMVSRDVLGGWCPDRL

SEQ ID NO: 417 - protein, 81 aa, Aotus trivirgatus
MAQESVMFSDVSIDFSQEEWECLNDDQRDLYRDVMLENYSNLVSMAGHSISKPNVISYLEQGKEPWLVDRELTRGQWPALE

SEQ ID NO: 418 - protein, 81 aa, Aotus trivirgatus
MAHRSVMFSDISIDFSPEEWEYLDLEQKDLYRDVMLENYSNLVSLGCFISKPDVISLLEQGKEPWKVVRKRRRQYPDLETK

SEQ ID NO: 419 - protein, 81 aa, Aotus trivirgatus
MAHDLVMFRDVAVDFSQEEWECLNSYQRNLYKDVILENYSNLVSLGCSISKPDVITLLEQGKEPWLVVRDEKRRWSLAPTF

SEQ ID NO: 420 - protein, 81 aa, Aotus trivirgatus
MINYQTPVSFKDVVVGFTQEEWHRLNPTQRALYRDVMLETYSNLVSVGYEGTKPDVILRLEQEEAPWIGEAACLGCHCWED

SEQ ID NO: 421 - protein, 81 aa, Aotus trivirgatus
GRSPRKTDQFCNSKNMVPGSVTFRDVAIDFSQEEWECLQPAQRTLYRDVMLENYSHLISLGSSISKPDVITLLEQEKEPWM

SEQ ID NO: 422 - protein, 81 aa, Aotus trivirgatus
CGMFQVSVAFEDVAVTFTQEEWALLDPSQKTLYRDVMQENFRNLASVGKKWKAQNIYVEYKNLRRNLRNLRGKRLFESKED

SEQ ID NO: 423 - protein, 81 aa, Aotus trivirgatus
TMTTVSSTARPQESVAFDDVAVYFTKKEWAIMVPDQRALYRDVMLENYEAVAFVVPPTSKPALVSHLEQGKEPCFTQPQGV

SEQ ID NO: 424 - protein, 81 aa, Aotus trivirgatus
MAVDLLPAQESMTFRDVAVFFSQDEWLHLDSAQRALYREVMLENYSTLVSLGIPFSMPKVIHQLQQGQDPCMVEGEVPSDI

SEQ ID NO: 425 - protein, 81 aa, Aotus trivirgatus
REPAQVLVAAESLIDNEEGYVTFEDVAVYFSQEEWRLLDEAQRLLYRNVMLENFSLMASLGLASSKTHEITQLESWEEPFV

SEQ ID NO: 426 - protein, 81 aa, Aotus trivirgatus
MAAAALREPAQGYVTFEDVAVYFSQEEWRLLDEAQRLLYRNVMLENFSLMASLGLASSKTHEITQLESWEEPFVPAWDVMT

SEQ ID NO: 427 - protein, 81 aa, Aotus trivirgatus
MATALTDPAQVSVTFDDVAVTFTQEEWGQLDLAQRTLYQEVMLENCGLLVSLGCPVPRPELIYHLEHGQEPWTRKEDLSQG

SEQ ID NO: 428 - protein, 81 aa, Aotus trivirgatus
MNVEVLKVISQDLVTFKDVAIDFSQEEWQWMNPAQKRLYRSMMLENYQSLVSLGLCVSKPYVISLLEQGREPWEMTSEMTR

SEQ ID NO: 429 - protein, 81 aa, Aotus trivirgatus
QDPSAEQLSEEVPVVFEELPVVFEDVAVYFTREEWGMLDKRQKELYRDVMRMNYELLASLGPAAAKPDLISKLERRAAPWI

SEQ ID NO: 430 - protein, 81 aa, Aotus trivirgatus
MDVAQEQVTFQDVAIYFSWEEWECLEPSQRALYRDVMLDNFSNVAALGFCSPRPDLVSRLEQWEEPWVEDRDRPELQAVQR

SEQ ID NO: 431 - protein, 81 aa, Homo sapiens
CQELVTFEDVAVYFSLEEWERLEADQRGLYQEVMQENYGILVSLGYPIPKPDLIFRLEQGEEPWVPDSPRPEEGDIVTGVY

SEQ ID NO: 432 - protein, 81 aa, Rattus norvegicus
SKAPVTFGDLAIYFSQEEWEWLSPNQKDLYEDVMLENYHNLVSVGLACRRPNIIALLEKGKAPWMVEPSRKRRGPELGSKD

SEQ ID NO: 433 - protein, 81 aa, Homo sapiens
YQEMVTFEDVAVHFTKTEWTGLSPAQRALYRSVMLENFGNLTALGYPVPKPALISLLERGDMAWGLEAQDDPPAERTKNVC

SEQ ID NO: 434 - protein, 81 aa, Homo sapiens
YQIPVSFKDVVVGFTQEEWHRLSPAQRALYRDVMLETYSNLVSVGYEGTKPDVILRLEQEEAPWIGEAACPGCHCWEDIWR

SEQ ID NO: 435 - protein, 81 aa, Homo sapiens
EPGAVSFADVAVYFCREEWGCLRPAQRALYRDVMRETYGHLSALGIGGNKPALISWVEEEAELWGPAAQDPEVAKCQTQTD

SEQ ID NO: 436 - protein, 81 aa, Homo sapiens
EMGLLTFRDIAIEFSLEEWQCLDCAQRNLYRDVMLENYRNLVSLGIAVSKPDLITCLEQNKESQNIKRNEMVAKHPVTRSH

SEQ ID NO: 437 - protein, 81 aa, Homo sapiens
SQGSVTFRDVAIDFSQEEWKWLQPAQRDLYRCVMLENYGHLVSLGLSISKPDVVSLLEQGKEPWLGKREVKRDLFSVSESS

SEQ ID NO: 438 - protein, 81 aa, Homo sapiens
AQESVTFEDVAVNFTNREWQCLTYAQRHLYKDVMLENYGNMVSLGFPFPKPPLISHLEREVDPCVQDPQDRESLSCSYPVS

SEQ ID NO: 439 - protein, 81 aa, Homo sapiens
VQEPVTFKDVAVDFTQEEWGQLDLVQRTLYRDVMLETYGHLLSVGNQIAKPEVISLLEQGEEPWSVEQACPQRTCPEWVRN

SEQ ID NO: 440 - protein, 81 aa, Homo sapiens
SQASVSFKDVTIEFTQEEWQQMAPVQKNLYRDVMLENYSNLVSVGYCCFKPEVIFKLEQGEEPWFSEEEFSNQSHPKDYRG

SEQ ID NO: 441 - protein, 81 aa, Homo sapiens
SQELLTFKDVSVDFTQEEWGQLAPAHRNLYREVMLENYGNLVSVGCQLSKPGVISQLEKGEEPWLMERDISGVPSSDLKSK

SEQ ID NO: 442 - protein, 81 aa, Bos taurus
HQEVVTFEDVAVYFTRTEWAGLSPAQRALYRSVMLEIYRSLTSLGYPVPKPALISLLERGDLPVGLETQDNPPAQGTRDIY

SEQ ID NO: 443 - protein, 81 aa, Homo sapiens
SKAPITFGDLAIYFSQEEWEWLSPIQKDLYEDVMLENYRNLVSLGLSFRRPNVITLLEKGKAPWMVEPVRRRRAPDSGSKC

SEQ ID NO: 444 - protein, 81 aa, Homo sapiens
ALRSVMFSDVSIDFSPEEWEYLDLEQKDLYRDVMLENYSNLVSLGCFISKPDVISSLEQGKEPWKVVRKGRRQYPDLETKY

SEQ ID NO: 445 - protein, 81 aa, Homo sapiens
SWGPLSFMDVFVDFTWEEWQLLDPAQKCLYRSVMLENYSNLVSLGYQHTKPDIIFKLEQGEELCMVQAQVPNQTCPNTVWK

SEQ ID NO: 446 - protein, 81 aa, Mus musculus
SLGPLSFKDVAVAFSQEEWQQLDPEERTTYRDVMLETYSNLVSVGYDIIKPDVIIKLEQGEEPWIVEGAFSPQSYPDEIRH

SEQ ID NO: 447 - protein, 81 aa, Homo sapiens
RQAFLAFGDVTVDFTQKEWRLLSPAQRALYREVTLENYSHLVSLGILHSKPELIRRLEQGEVPWGEERRRRPGPCAGIYAE

SEQ ID NO: 448 - protein, 81 aa, Bos taurus
QAEVTFEDVAVFLSQEEWGLLGPAQKGLYREVMLETYRNLVSLGAGLAGPKPEVIAQLEQGDELWVLDMHGAEQPSVDGSA

SEQ ID NO: 449 - protein, 81 aa, Homo sapiens
SQGRVTFEDVTVNFTQGEWQRLNPEQRNLYRDVMLENYSNLVSVGQGETTKPDVILRLEQGKEPWLEEEEVLGSGRAEKNG

SEQ ID NO: 450 - protein, 81 aa, Mus musculus
SKAPVTFGDLAIYFSQEEWEWLSPMQKDLYEDVMLENYHNLVSVGLACRRPNIIALLEKGKAPWVIEPSRRRWGPESGSKY

SEQ ID NO: 451 - protein, 81 aa, Pongo sp.
RQEPVTFEDVAVYFTQNEWASLDSVQRALYREVMLENYANVASLAFPFTTPVLVSQLEQGELPWGLDPWEPMGREALRGIC

SEQ ID NO: 452 - protein, 81 aa, Homo sapiens
SLGSELFRDVAIVFSQEEWQWLAPAQRDLYRDVMLETYSNLVSLGLAVSKPDVISFLEQGKEPWMVERVVSGGLCPVLESR

SEQ ID NO: 453 - protein, 81 aa, Pongo sp.
MVTFEDVAVHFTKTEWTGLSPAQRALYRSVMLENFGNLTALGYPVPKPALISLLEGGDMAWGLEAQDDPPAETTKNVRKDV

SEQ ID NO: 454 - protein, 81 aa, Homo sapiens
KPGTVSFADVAVYFSPEEWGCLRPAQRALYRDVMQETYGHLGALGFPGPKPALISWMEQESEAWSPAAQDPEKGERLGGAR

SEQ ID NO: 455 - protein, 81 aa, Homo sapiens
QAEVTFEDVAVYLSREEWGRLGPAQRGLYRDVMLETYGNLVSLGVGPAGPKPGVISQLERGDEPWVLDVQGTSGKEHLRVN

SEQ ID NO: 456 - protein, 81 aa, Homo sapiens
ARGKSKSKAPITFGDLAIYFSQEEWEWLSPIQKDLYEDVMLENYRNLVSLGLSFRRPNVITLLEKGKAPWMVEPVRRRRAP

SEQ ID NO: 457 - protein, 81 aa, Homo sapiens
SQGLVTFGDVAVDFSQEEWEWLNPIQRNLYRKVMLENYRNLAWLGLCVSKPDVISSLEQGKEPWTVKRKMTRAWCPDLKAV

SEQ ID NO: 458 - protein, 81 aa, Homo sapiens
SKAPITFGDLAIYFSQEEWEWLSPIQKDLYEDVMLENYRNLVSLGLSFRRPNVITLLEKGKAPWMVEPVRRRRAPELVTVA

SEQ ID NO: 459 - protein, 81 aa, Saimiri boliviensis
VQEPVTFKDVAVDFTQEEWGQLDLVQRTLYRDVMLETYGHLLSVGNQIAKPEVISLLEQGEEPWSLEQTCPQRACPEWMRN

SEQ ID NO: 460 - protein, 81 aa, Rattus norvegicus
KPELVSFADVAVYFSPQEWGCLRPAQRALYREVMRETYGLLGALGFPGPKPALISWMEQESEAWSPAAQDPEEGESLGGAP

SEQ ID NO: 461 - protein, 81 aa, Terrapene carolina
PSGLVTFEEVAVYFTREEGALLDPTQRALYRDVMQENYETVVLLGFPVSKPDVISQLERGEEPWVPDLQGSEKEVLPRAAC

SEQ ID NO: 462 - protein, 81 aa, Terrapene carolina
MSVTFEDVAMYFSPAEWVLLGEEQKQLYRHVMWENYQTLVSLGIQISKPVVISSIERGEELWAQSPTEDEDEDILSGTSPG

SEQ ID NO: 463 - protein, 81 aa, Gopherus agassizii
LVPVTFEDVAVYFSREEWGLLDDMQRTFYRDVMKENYQTVVSLPGSSIPKPDVISQMERGEEPWVPDLQKLGPHQTPENPL

SEQ ID NO: 464 - protein, 81 aa, Gopherus agassizii
MPVTFEEVAVYFTEGQGALLDPAQRALYRDVMQEIYEMVISLGFLLPKPDVIIQLERGEEPWVPDLQGSAEREMSRGTCAG

SEQ ID NO: 465 - protein, 81 aa, Podarcis muralis
GLVSFDEVSVHFTNEEWALLDPGQRALYEEVMEEIREMMTSVGDVSEFLTEGEQSEPSREGAEEQKEQRKQRVQVGTYRKE

SEQ ID NO: 466 - protein, 81 aa, Podarcis muralis
GSVSFDEVSVRFSNEEWALLDPGQRALYEEVMEEIREMMTSVGDVSEFLTEGEQSELSREGAEEQKEQRKQRVQVGTYRNE

SEQ ID NO: 467 - protein, 81 aa, Gopherus agassizii
FQIPVTFEEVAVYFTQGQGALLDPAQRALYRDVMQENYETVTSLGFPIPKPDLIARLERGEEPWVLDLQASDESVSLRGTC

SEQ ID NO: 468 - protein, 81 aa, Alligator sinensis
VVLLEAFEDVAVYFTQKEWALLDDGDKALYRDQMLRNYQALISLGYRGPTPALINRIQRGEMELWVCDKDYGEKSSLEGLF

SEQ ID NO: 469 - protein, 81 aa, Paroedura picta
FSLEDVSVSFSPAEWALLDPAQRALWREVMRENAENVAFLARSIGETLVEANNDPVSEGRLERSSGGAEEQISFPNGLAKR

SEQ ID NO: 470 - protein, 81 aa, Paroedura picta
AQVAFEDVAVYFTEEQWALLDHSQRALYRDVMQENYETVASLGLPIPGPDSISRLQQREESRIEAQPVLEGNDVSSDDDLG

SEQ ID NO: 471 - protein, 81 aa, Paroedura picta
AQRPVTFEDVAVYFSEAQGTLLDPDQKALYREVMMENYENVASLGSLTPKPELIIRLERGEEPWVSDPGDAPVSGDFRKSH

SEQ ID NO: 472 - protein, 81 aa, Paroedura picta
AQAGVSFEEVAVHFSPGEWSLLQPAQRALYKEVMLENFGHVASLGPPGATPDLIAWLQEGLFLLGGDEEAGSAGDAWRSAT

SEQ ID NO: 473 - protein, 81 aa, Terrapene carolina
FQGLVTFEEVAVYFTREEGALLDPTQRALYRDVMQENYETVVLLGKESFSKPDVISQLERGEEPWVPDLQGSEKERPEENF

SEQ ID NO: 474 - protein, 81 aa, Terrapene carolina
AQGPVTFEEVAVYFTREEGALLDPTQRALYRDVMQENYETVVLLGFPVSKPDVISQLEQGEEPWIPDLQGSEKEVLPRAAC

SEQ ID NO: 475 - protein, 81 aa, Terrapene carolina
FQMPVTFEEVAVYFTQGQGALLDPAQRALYRDVMQDNYEMVTSLGFPIPKPELIARLERGEEPWVPDLQACEERRLPRCTR

SEQ ID NO: 476 - protein, 81 aa, Podarcis muralis
GSVSFDEVSVRFSNEEWALLDPGQRALYEEVMEEIREMMTSVGDVSEFLTEGEQSEPSREGAEEQKEQRKQRVQVGTYRKE

SEQ ID NO: 477 - protein, 81 aa, Microcaecilia unicolor
QMLVTFEDIAVSFSKEEWEYLDEGQKELYREVMKENYQTLISLGTGFPTVIPEIISHIEQGDEPGSEERENGKSSCSGESG

SEQ ID NO: 478 - protein, 81 aa, Microcaecilia unicolor
FQTLLAFEDVAVFFSEEEWELLDELQKEVYKNTMRENYETLLSLGLTNMKPEIIAKIDAGEAPSVQNASYLEKRGKKSAAG

SEQ ID NO: 479 - protein, 81 aa, Microcaecilia unicolor
QVPVTFEDITIYFSQEEWEGLQEWQKELYKDVMKENYEILISLGASSPILTPDVISHIERGEEPYIRDEPRSEERESGKSS

SEQ ID NO: 480 - protein, 81 aa, Alligator mississippiensis
AQGPVTFEDVAVYFSAEEWQELAGWQRELYRDVMMDTYELVASLGPAGLKPEVVSKLERGEEPHQPARSRESPRAPLPVLL

SEQ ID NO: 481 - protein, 81 aa, Callipepla squamata
EPVSFEEVAVYFSREEWALLDPAQRALYWDVMLETYECVASLAPLPGPKPMVISLLEEGEEPWIPDVGSPEAVAGDVSPGE

SEQ ID NO: 482 - protein, 81 aa, Alligator mississippiensis
SKLPEAFEDVAVYFTRKEWELLEAGDKGLYQDQMLRNYQALVSLGLQGPAPDLICRMQLGEMELWVCDDEEAGESSLSEDF

SEQ ID NO: 483 - protein, 81 aa, Alligator mississippiensis
DQLQEAFEDVALYFTQNEWELLGDGDKVLYRDQMLRNYQALVSLGYQGPAPDLISRIQRQEVELWVCEEENPGESVWTEGL

SEQ ID NO: 484 - protein, 81 aa, Phasianus colchicus
CQEPVSFAQVAVYFSREEWALLDPAQRALYRDVMLETYQCVASLAPLPAHKPMVISLLEGGEDPWIPDVRSPEAVPGDLSP

SEQ ID NO: 485 - protein, 81 aa, Phasianus colchicus
CQEPVSFAQVAVYFSREEWALLDPAQRALYRDVMLETYQCVASLAPLPAPKPMLISLLEGGEDPWVPDVCSPEAVPGDLSP

SEQ ID NO: 486 - protein, 81 aa, Microcaecilia unicolor
QVPVIFEDVAVYFWEEEWEMLEEWQKELYKETMKENYKTLVSLGMELPTEKPDLIVRIEREENPCVKAQWDSRDKTRWRNS

SEQ ID NO: 487 - protein, 81 aa, Microcaecilia unicolor
MRVTFEDIAVSFSQEEWEYLDEEQKELYREVMKENYQTLISLGAGSLTFTPEIISHIERGEEPYSRDEPGSGEREPGKSRC

SEQ ID NO: 488 - protein, 81 aa, Microcaecilia unicolor
DRVKFTFSDVAVYFSEEEWQLLEEQQKELYRNVMKENYTTLTSLGYTTVKPDVISKIEQGKQPSVSSPSGSKGRRAVGRPT

SEQ ID NO: 489 - protein, 81 aa, Microcaecilia unicolor
QVPVTFEDIAIYFCQEEWEVLEEWQKDLYKDVMKENYQALISLGTGSLIVSPDIISRIERGEDPYIRDERGSKKRETENSS

SEQ ID NO: 490 - protein, 81 aa, Microcaecilia unicolor
VQVPVTFEDVAVYFSEDEWGMLAGWQKELYKETMKENYETLTLLGCLSEKPSLISKIEREEDPCVRDQQDPRDRRKLRSSW

SEQ ID NO: 491 - protein, 81 aa, Microcaecilia unicolor
TQMQVKFDDIAVSFSQEEWKYLDEEQKELYREVMKENYQILISLGTGSSTTPKIISHIERGEEPYIRDEPVLVERKTGKSS

SEQ ID NO: 492 - protein, 81 aa, Terrapene carolina
MPVTFEEVAVYFTQGQGALLDPAQRALYRDVMQENYETVTSLGFPIPKPELIARLERGEEPWVPDLQACKERRLPRCTRTG

SEQ ID NO: 493 - protein, 81 aa, Microcaecilia unicolor
AQMQVTFEDIAVFFCHEEWKYLDDGQKELYKEVMKENYETLISLGFLCEKPSLISKIEREEDPCVRDQQDFRERRRRLKSF

SEQ ID NO: 494 - protein, 81 aa, Microcaecilia unicolor
QVPVTFEDIAVSFSQEEWKYLDEGQKNLYWEVMKENYETLISLADSEVEQEDKRAKNREECPMLWGLIPRQSRKNSEKVSW

SEQ ID NO: 495 - protein, 81 aa, Gopherus agassizii
MPVTFEDVAVYFTQGQGALLDPTQRALYRDVMQENYETVTSLGKSVKGFPLAKPDLITRLERGEEPWVSDLQATGDERMSE

SEQ ID NO: 496 - protein, 81 aa, Gopherus agassizii
LEGLVTFEEVAVYFTESEWSLLDPAQRALYRDVMEENYENVTSLGFPVSKPDVISWLERGEDPWVPDLQDPEKRETLREAC

SEQ ID NO: 497 - protein, 81 aa, Gopherus agassizii
KHGPVTFEEVAVYFTREEWALLDPTQRALYRDVMQENYEMVVLLGFLNSKPDVISQLEQGEEPCIVDLQGSEKEVLPRAAC

SEQ ID NO: 498 - protein, 81 aa, Gopherus agassizii
FQMPVTFEEVAVYFTQGQGALLDPAQRALYRDVMQENYKMVTSLGFPLPKPELISRLEQGEEPWVPDLQACEERESLSGNH

SEQ ID NO: 499 - protein, 81 aa, Alligator sinensis
SKLSEAFEDVAVYFTWKEWALLEAADKMLYRDQMLKNYQALFSLGYRGPTPDLICRIQRGEMELWVSDLEEAGESSLSEDS

SEQ ID NO: 500 - protein, 81 aa, Alligator sinensis
MEPRDAFEDVAVYFTREEWALLDDGDKGLYRDQMLRNYQALVSLGYRGPTPDLICCIQRGKVELWVRDGEDHGEISGSEDL

SEQ ID NO: 501 - protein, 81 aa, Gallus gallus
LQEPVSFAEVAVYFSREEWALLDPAQRALYRDVMLETYQCVAWLAPLPAPKPGLISLLEGGEDPWIPDVRSPEAVPGDLSP

SEQ ID NO: 502 - protein, 81 aa, Gallus gallus
AREPVSFVEVAVYFSREEWALLDPAQRALYRDVMLETYESVASLGPFPAPKPVVISLLEGGDDPWIPDVHSPEAVSGDFSP

SEQ ID NO: 503 - protein, 81 aa, Chelonia mydas
VPVTFEDVAVRFSAEEWEILEGWQKELHKEVMEENYQLLISLGQPVPTLALLALTAEREAAGGQIRSVSGERELASKGGSS

SEQ ID NO: 504 - protein, 81 aa, Columba livia
GKMSVTFEDVALYFSPEEWAKLSGCQRQLYQEVMLENYQMVASLGWANVKPEIICKMEREETPCVPDVPGKQQRHQSPVPV

SEQ ID NO: 505 - protein, 81 aa, Pogona vitticeps
VAFEDVAVYFTAEEWDLLGPNQKSLYSEVMMENYENVSYLADNWKKTIAFAHSQKDFIHKLHQRTHKEDEHHTRAEPCEST

SEQ ID NO: 506 - protein, 81 aa, Meleagris gallopavo
LQEPVSFAEVAVCFSREEWALLDPAQRVLYRDVMLETYQCVASLASLLTPKPVLISLLEGGEEPWIPDVRSPEATPGDLSP

SEQ ID NO: 507 - protein, 81 aa, Columba livia
GKMSVTFEDVALYFSPEEWAKLSGCQRQLYREVMLENYQMVASLGWATVKPEIICKMEREETPCVLDPPGEQQMHQSPVPA

SEQ ID NO: 508 - protein, 81 aa, Pogona vitticeps
PQDSVTFEEVAVSFSREEWALLTDWQKNLYKDVMRDNYEMLNSLDLAAHKPDIILRIERGQEPCVGRLQRSKARERPNHVF

SEQ ID NO: 509 - protein, 81 aa, Chelonia mydas
KTAPVTFDDVAVYFSAEEWEELAEWQKELYKDVMRDNYEALISLGHAAAKPDIIQLLEHGEEPCVKGHKDSGNGKAFNFIS

SEQ ID NO: 510 - protein, 81 aa, Columba livia
WQEPVTFEDVAVYLSHAEWDAMAPEQRELYCSVMLDNYQLLASLGYPGPKPDIVYRLERGEEPWGCAPQSPLSWDGPRSPS

SEQ ID NO: 511 - protein, 81 aa, Columba livia
GKMSVTFEDVALYFSPEEWAKLSGCQRQLYREVMLENYQMVASLGWANIKPEIICKMEREETLCVPAPPREWQRDQSPVPA

SEQ ID NO: 512 - protein, 81 aa, Terrapene carolina
FQMPVTFEEVAVYFTQGQGALLDPAQRALYRDVMQENYEMVTSLGFPIPKPELIARLERGEEPWVPDLQACKERRLPRCTR

SEQ ID NO: 513 - protein, 81 aa, Patagioenas fasciata
QDAVTFKDVAIYFSPEEWVRLSAGQRELYQEVMLDNYELVTSLDRECKLLYKMDPEEEPCEGVPCRGVDSGALDNSSTSAC

SEQ ID NO: 514 - protein, 81 aa, Gallus gallus
CQEPVSFAEVAVYFSREEWALLDPAQRALYRDVMLETYQCVAWLASLPAPKPGLISLLEGGEDPWIPGVRSPEAMPGDLSP

SEQ ID NO: 515 - protein, 81 aa, Callipepla squamata
PSVPVTFRDVFVQFSRDEWALLDDEQKELHQSVMQSNYEVLMSLYCDLAKPEVLLQMERGEPCLPAEPDLQGAAVSLNPAA

SEQ ID NO: 516 - protein, 81 aa, Callipepla squamata
LQEPVSFEEVAVYFSREEWALLDPAQRALYRDVMLETYECVASLAPLPAPKPMVISLLEEGEEPWVPDVGSPEAVAGDVSP

SEQ ID NO: 517 - protein, 81 aa, Callipepla squamata
EPVSFEEVAVYFSREEWALLDPAQRALYRHVMLETYECVASLAPLPAPKPMVISLLEEGEEPWIPDEGSRQAVAGDVSPGE

SEQ ID NO: 518 - protein, 81 aa, Alligator mississippiensis
AQRWEAFEDVALYFTQKEWELLRDGDKVLYQEQMLRNYQALVSLGYQGPTPDLICRIQRGDMELWVCDDEDPKESMWSEGL

SEQ ID NO: 519 - protein, 81 aa, Dipodomys ordii
APGSVTFRDVAIDFSQEEWKWLQPAQRDLYRCVMLENYGHLVSLGLCISKPDVVSLLEQGKEPWLGKGGVNRDLFSVSDGK

SEQ ID NO: 520 - protein, 81 aa, Cavia porcellus
RPRALKFADVAVYFSLEEWGCLRPAQRTLYRNVMRETYGHLGALGCAGPKPALISWLERNTDDWEPAALDPQEYPRGVTVQ

SEQ ID NO: 521 - protein, 81 aa, Cricetulus griseus
KPELVSFEDVAVYFSPHEWGCLRPAQRALYREVMRETYGLLGALGFPGPKPALISWMEQESEAWSPAAQDPAEGESLGGAL

SEQ ID NO: 522 - protein, 81 aa, Cricetulus griseus
EQGLVSFEDVAVDFTWQEWQELDAAQRTLYRDVMLENYSSLVSLGHCVTKPELIFRLEHGFGPWSIGETSLWNLPGVLEVP

SEQ ID NO: 523 - protein, 81 aa, Cricetulus griseus
KVKQFSFQSLLTFKDLAINFSKEEWEYLNTSQKDLYKDVMLENYSNLVSVGLSESKPELVTCLEQNKEPWMVHIVEAEGLE

SEQ ID NO: 524 - protein, 81 aa, Mus musculus
MESVSFEDVAVKFTQEEWAVLDPSQKKLYKDVMQETLKNLASIGNKSGKQKVINEYGKLWRKLSSHLAGKFSDYNENHQCA

SEQ ID NO: 525 - protein, 81 aa, Mesocricetus auratus
SQVSVTFEDVAVLFTRDEWKKLDHSQRSLYREVMLENYSNLASLGFPFAKPEMISVLQQGEEPWKVEKRSLGFSLGCNSSL

SEQ ID NO: 526 - protein, 81 aa, Mus caroli
QASVTFEDVAVRFTQEEWALLDPSQKILYGDVMQETYRNLTSVGINWECWDLEAYFRSLERNLRVQLVKRDCELKNNDPCG

SEQ ID NO: 527 - protein, 81 aa, Cricetulus griseus
MLSFWDVAIEFSPEERECLDPAQWSLYRDVMLENYSNLLFLGLAVPKPHLVTFLEQRQESSGVKRQAAATVHPGRIPNDYN

SEQ ID NO: 528 - protein, 81 aa, Rattus norvegicus
ARGLMAFEDVAVYFSQEEWMFLNAAQRALYRHVMLENFALVDSIGPSVSRPRVIIQLQRGEEPWVPNRTIAGPGRGTHRRS

SEQ ID NO: 529 - protein, 81 aa, Mus caroli
SQVSVTFEDVAVLFTRDEWKKLVPSQRSLYREVMLENYSNLASLAGFPFTKPKVISLLQQGEDPWKVEEEGPGGFSLGLKC

SEQ ID NO: 530 - protein, 81 aa, Peromyscus maniculatus
FQNSLTYDDVHINFTCEEWALLDASQKRLYKDVMLETYSNLTAIGYKWEDHNIEEHCQRFRRRGRHKRSRTEERPYECKQC

SEQ ID NO: 531 - protein, 81 aa, Peromyscus maniculatus
DAVTYEDVHVNFTHEEWALLDPSQKSLYKDVMLETYWNLTSIGYKWEDHNFEENCQSSRRHGRHINCPSGYKPCEHEEYGK

SEQ ID NO: 532 - protein, 81 aa, Mesocricetus auratus
MNTVTYDDVHVNFTWEEWTLLDPSQKNLYKDVMLETYRNLTAVGYSWEDHNVEEHCQSYRRHSRLERSHTGEKSSVHTQCV

SEQ ID NO: 533 - protein, 81 aa, Ictidomys tridecemlineatus
SQEAVTFEDVAVYFTQNQWASLEPAQKALYQEVMLENYANITSLAALPFPKPDLIFQLELGEAPWVPDSWRPVGEEALGGR

SEQ ID NO: 534 - protein, 81 aa, Ictidomys tridecemlineatus
SQGPVLFEDVSVDFTQKEWQLLDPAQRRLYRDVMLENYRHLESLGHCVTKPELIRRLEQGEEPWILKREVPSHSHAEVQRA

SEQ ID NO: 535 - protein, 81 aa, Marmota monax
SKAPVTFGDLAIYFSQEEWEWLSPIQKDLYEDVMLENYTNLVSLGLSSRRPNVIALLEKGKAPWMVEPPRRRQGPDSRSKC

SEQ ID NO: 536 - protein, 81 aa, Mus caroli
CQALVTFEDVAVTFTDDEWKRLVPVQRALYKAVMLENYESIISLGLPVPRPDLILQFKRRGEPWMRGFHGSEEKAWPESVS

SEQ ID NO: 537 - protein, 81 aa, Peromyscus maniculatus
EQDAVTYEDVHVNFTHEEWALLDPSQKSLYKDVMMETYWNLTCIGYKWEDHNIEEHCQSCRRNGSRCVICHSGHNPCEHKG

SEQ ID NO: 538 - protein, 81 aa, Peromyscus maniculatus
SKAPVTFGDLAIYFSQEEWEWLSPIQKDLYEDVMLENYQNLVLLGLACRRPNIITLLEKGKAPWVVEPSRRRRGPESGSKC

SEQ ID NO: 539 - protein, 81 aa, Cavia porcellus
QEIPVSFKDVVVGFTQEEWHWLNPVQRALYRDVMLETYSNLVSVGYEGTKPDVILRLEQEEAPWVCEAPCPGCCCWEDIWQ

SEQ ID NO: 540 - protein, 81 aa, Mus musculus
QCLLTFKDVFLDFSSEEWECLNFAQRTLYMDVMLENYNNLLFVENHCICGNYEKEKVLEQDTQHIVNEHGHNRKKSSKCNE

SEQ ID NO: 541 - protein, 81 aa, Cricetulus griseus
SKASVTFGDLAIYFSREEWEWLSPIQKDLYEDVMLENYQTLVSLGLVCRRPNIITLLEKGKAPWMVEPSRRRRGPESGSKR

SEQ ID NO: 542 - protein, 81 aa, Peromyscus maniculatus
MDAVTYEDVQVSFTREEWTLLDPSQKSLYKDVMVETYRNLTAIGYKWEDQNIKKHHQCSRRHGRHERSNSAEKDYECEQCG

SEQ ID NO: 543 - protein, 81 aa, Peromyscus maniculatus
HKKSMVFSDVSLDFSQEEWECLGPAQKDLYRDVMLENYSHLLSVAGLHIPKPQVISLLEQGKEPWMIGKELTRGLCSALES

SEQ ID NO: 544 - protein, 81 aa, Peromyscus maniculatus
MNAVTYDDVHVDFTWDEWALLDPSQKNLYKNVMLETYRNLTAIGYKWEEHNINEKFQRSRRNRRHERSHTGEKSYECNQCG

SEQ ID NO: 545 - protein, 81 aa, Mesocricetus auratus
DAVTYQDLHITFTQEEWALLDSSQRNLYKDVMLETYMNLNAIGYKWEDNDIEQHCRSPQRHGRHERSPTREKPSAYMQCDK

SEQ ID NO: 546 - protein, 81 aa, Mus caroli
AHSMVMFRDVTVDFSQEEWECLSSYERDLYRDVMLENYSHLVSLAGCSISKPDVITLLEQGKEPWMIVRAEKRRWSRDLES

SEQ ID NO: 547 - protein, 81 aa, Mus musculus
RERLVSFEDVTVDFSQEEWRRLDSVQRHLYQDVMLEIYSHLLAVGYPVPSPGAIFRIKKRKEARTGEAKLPHPCWCQEVES

SEQ ID NO: 548 - protein, 81 aa, Cricetulus griseus
CNSWISPSDVAINFSKEEWECLHPSQKDLYRDVMLENYSNLVSVGLSESKPELVTCLEENKEPWMVNIDEAEGLGQGVFCY

SEQ ID NO: 549 - protein, 81 aa, Rattus norvegicus
APLPLTFEDVAIYFSEQEWQHLETWQKELYKQVMRTNYETLISLDNGLPKPELISWMELGRENFGSWGEGQKVDRGIRCSV

SEQ ID NO: 550 - protein, 81 aa, Mus musculus
KPGTVSFADVAVYFSPEEWRYLRPAQRALYREVMRETYGLLTYLDVGCAKPALISWVEEESEVWGPGAQDPEVAMCRTEVH

SEQ ID NO: 551 - protein, 81 aa, Mus caroli
DKALMAFHDVAVAFSQMEWELLSPAQRILYREVMLENYSHLVSLGIAFSKPKLITQLEQGAEPWRDGSGCFLDLCPAEPRT

SEQ ID NO: 552 - protein, 81 aa, Mus caroli
VCGSVTFKDVAVDFSQEEWACLDATQKVLYRDMMLETYSNLVAVVGRCISKPDLIVLLEQEKEPWMAVKEETDRPSPDLES

SEQ ID NO: 553 - protein, 81 aa, Cricetulus griseus
MAFEDVAVYFSQEEWVFLDAAQRALYRHVMLENFALVDSIGLSISRPRVIIQLQRGEEPWVPNRTNTGPGRGTRRRPSLGS

SEQ ID NO: 554 - protein, 81 aa, Mesocricetus auratus
MESVSFEDVAVNFTPEEWALLNSSQKRLHRDVMQENFRNLAAIAKNQEDPTLEDDYEYLRKILPFAVQTGYRLCENQDYAE

SEQ ID NO: 555 - protein, 81 aa, Mus musculus
MDAVTYEDVHVNFSQEEWALLDPSQKSLYKDVMLETYWNLTCIGYKWEDHNIEDQHQSSGRHGRCINCPSAYGKKQCTNLF

SEQ ID NO: 556 - protein, 81 aa, Mus musculus
LLHGCCSLETHSIRDKNAVTYGDVHVNFTQEEWALLDPSQKKLYKDVMLETYRNLNAIGFNWDDKNTEEHCPSTRRWRRYP

SEQ ID NO: 557 - protein, 81 aa, Mesocricetus auratus
PADRDAVTYDDVHIGFTQEEWVLLNPSQKSLYKDVMLDTYRNLTAIGYRWQDHNIEEHCENSRRHRRKFSCTTKPYESLQN

SEQ ID NO: 558 - protein, 81 aa, Peromyscus maniculatus
MGSVSFEDISLDFTWDEWQDLDSAQRTLYRDVMLENYSSLMFLGHCTTKPELIFKLEHGFGPWSLAEASIQSLPGVHKMTV

SEQ ID NO: 559 - protein, 81 aa, Mesocricetus auratus
SQGLVTFGDVAVVFSQEEWEWLSSEQRSLYWRVMLDNYRNLASLGLCASKPDMIALLEQGKDPCVLKRKTARGLRPDLEAV

SEQ ID NO: 560 - protein, 81 aa, Marmota monax
FQELVSFNDVTVGFTQEEWQHLDPSQRSLYREVMLENYSHLVSVGYCVTKPEVIFRLEQGEEPWISEAEFPSQSFPELWKA

SEQ ID NO: 561 - protein, 81 aa, Mus caroli
VCGSVTFKDVAVDFSQEEWACLDATQKVLYRDMMLETYSNLVAVVGHCISKPDLIVLLEQEKEPWMTVKEETDRPSPDLEA

SEQ ID NO: 562 - protein, 81 aa, Peromyscus maniculatus
SGSQDAVTYEDVHVNFTPEEWALLDSSQKSLYKEVMLETYRNLTSIGYKWEDLNIEEHCQSSRRLKRYIIGHSRYKPCDRE

SEQ ID NO: 563 - protein, 81 aa, Cavia porcellus
LRDLVTFEDVAVDFTQEEWALLDASQRSLYREVMLENCRNLASLGCHVDKPSLISQLEQEDQAMTEERGNLPGTCPDLETV

SEQ ID NO: 564 - protein, 81 aa, Peromyscus maniculatus
RPRALKFADVAVYFSPEEWGCLRPAQRLLYREVMRETYGLLGALGCAGPTPALISWLERNTDDWEPAALDPQEYRRWATFQ

SEQ ID NO: 565 - protein, 81 aa, Peromyscus maniculatus
ARVSVMFSDVSIAFSREEWEYLDLSQRDLYKDVMMENYRNVASLGYFISKPDVISLLEQGKEPWKVVRRRRRNPDLETKDE

SEQ ID NO: 566 - protein, 81 aa, Peromyscus maniculatus
FKELVVFRDVAVEFCREEWECLDPRQRSLYRDVMLETYGNFVSLGLAISKPSVISLLEQGKEPWMVEQAGWYPDLLSVNET

SEQ ID NO: 567 - protein, 81 aa, Marmota monax
TLGLLSFNDVSLEFSWEEWQLLDSAQRYLYREVILENYSNLLSVGYHGTKPDLIFRLEQGEEPWILNAKMSTQNCPEVWED

SEQ ID NO: 568 - protein, 81 aa, Cricetulus griseus
MAFEDVAVYFSQEEWVFLDAAQRALYRHVMLENFALVDSIGLSISRPRVIIQLQRGEEPWVSNRTNTGPGRGTRRRPSLGS

SEQ ID NO: 569 - protein, 81 aa, Cricetulus griseus
LINAVTYNDVHINFTQEEWALLDPSQKSLYKDVMLETYRNLTAIGYSCEDHNIEEHCQSSTRHRRYERRHSREKPSEYSQC

SEQ ID NO: 570 - protein, 81 aa, Mesocricetus auratus
SETGNAVTYDDVHISFTSKEWALLDPSQKSLYKDVMLEIYSHLTAIGYKWEAHDSEDHGQRFRRQRRHKRSHTEVKTYKCS

SEQ ID NO: 571 - protein, 81 aa, Cricetulus griseus
DSVTFEDVAISFTVEEWALLDPSQKKLHRDVMEETFRNLAAIGRTQDDQHIDNDHRYSRRNQRNEVVERLLERNKSSECKE

SEQ ID NO: 572 - protein, 81 aa, Cricetulus griseus
GNQFSFQSLLTFKDVAINFSKEEWECLHTSQRNLYRDVMLENYSNLVSVGLSESKPELVTCLEQNKEPWMVNIDEAEGLGQ

SEQ ID NO: 573 - protein, 81 aa, Mus caroli
MNGMTYDDVHVNFTGEEWALLSPSQKRLYKDVMLETYRNLTAIGYSWEDRNIEEHFQRSRRHGRHERSHTGENPSVYTQCN

SEQ ID NO: 574 - protein, 81 aa, Mesocricetus auratus
MGAVTYDDVHINFTQEEWALLNPSQKRLYKDVMHDTYSNLTATGYSLEDHYIEEHCQSSRRCRRHLQRHKKVHIGEKPYES

SEQ ID NO: 575 - protein, 81 aa, Marmota monax
PKVPVSFEDVAMYFTKTEWKLLDLKQRILYKQVMLENYGHLVSLGFAFSKPRLVSQLERGEGPWVADSLRGQAEAESHAGE

SEQ ID NO: 576 - protein, 80 aa, Mus musculus
MVLVSFEDVAVDFTWEEWQALDAAQRTLYRDVMLETYSSLVSLGHCMAKPELIFNLEQGLGPRSTAGASVWNLSGRTEDS

SEQ ID NO: 577 - protein, 81 aa, Mus caroli
DLVTYDDVHVNFTQEEWALLDPSQKNLYKDVMLETYRNLSAIGYIWEVHTSEDHFQTSRSHGRHERSCTAVQPSEFIQCGK

SEQ ID NO: 578 - protein, 81 aa, Cricetulus griseus
FQELVVFRDVAVEFCKDEWECLGPDQRSLYRDVMLETYSNFVSLGLAVSKPSVISLLEQGKEPWMVEQAGWYPDLLSVNET

SEQ ID NO: 579 - protein, 81 aa, Mesocricetus auratus
FQNSLTFDDVAVDFTQEEWVLMDQTQRDLYREVMLENYQNLFSAGCEITKPSLISWLEEDLQIGQREDFQEWEMQDTLREQ

SEQ ID NO: 580 - protein, 81 aa, Mus caroli
LNSAVTYDDVNVNFTREEWALLDSSQKSLYKDVMLETYRNLTAIGYNWEGHNIEEHCQSSRRHARTHKRTHTGEKSYECDQ

SEQ ID NO: 581 - protein, 81 aa, Dipodomys ordii
AVTQLTFEDVAVDFTPEEWRCLTPAQRALYRDVMLDTYRNLVSVGVSPPSMSVILPLEFQEEPWVAQSHVTTLGGLNGWEG

SEQ ID NO: 582 - protein, 81 aa, Peromyscus maniculatus
MVTFKDVAVAFSEEELRLLDPAQRKLYQEVMVENFQNLLSVGINNQSELRAVQDGGSHEALSCWQIWQRVIDNLTRCQDSM

SEQ ID NO: 583 - protein, 81 aa, Peromyscus maniculatus
KENAVTYDDIHIDFTREEWTLLDPSQKNLYKDVMLETYRHLTTIGYSWEDHNIEKYCESSRRHKSTVQRHKRTNTNENPYE

SEQ ID NO: 584 - protein, 81 aa, Heterocephalus glaber
EPWAITFADVAVYFSPEEWGCLQPTQRALYRDVMRDTYVLLSALGGGGAKPALISWVEREAELWDPDAQDPEVPKWPTEAD

SEQ ID NO: 585 - protein, 81 aa, Mus caroli
SQGLVTFGDVAVVFSQEEWEWLSSEQRSLYWKVMLDNYRNLASLGLCASKPDMITSLEQGRDPWMMKRKMRKGQRLDLKAM

SEQ ID NO: 586 - protein, 81 aa, Mesocricetus auratus
MAFEDVAVYFSQEEWMFLDAAQRALYRHVMLENFALVDSIGLSVSRPRVIIQLQRGEEPWVPNRTNPGPGRSTCRRPSLGS

SEQ ID NO: 587 - protein, 81 aa, Mus musculus
DMGLVSFEDVAVDFTWQEWQELDAAQRTLYRDVMLENYRSLVWLGHCLAKPELISKLEEGFEPWGVAEATEQCLPCAEDQT

SEQ ID NO: 588 - protein, 81 aa, Marmota monax
QQRPVSFKDVVVGFTQEEWRRLNPAQRALYRDVMLETYSNLVSVGYEGTKPDVILRLEQEEAPWICEAVCPGCHCQEDFLS

SEQ ID NO: 589 - protein, 81 aa, Mus musculus
VEEPVTFKDVAVAFTQEEWGQLDLVQRTLYRDVMLETYGHLLSVGNQIAKPEVISLLEQGEEPWSVEQGYPKSSCPEWMRN

SEQ ID NO: 590 - protein, 81 aa, Peromyscus maniculatus
MNTVTYDDVHIGFTWEEWTLLDPSQKNLYKDVMLETYRNLAIIGYSWEDHNIEEHYQNSRRHERHERSQTGMKTSVHTQCS

SEQ ID NO: 591 - protein, 81 aa, Marmota monax
FKGPVTFKDVTVEFTKEEWKLLTPAQRTLYKDVMLENYNHLVSVGYRVSKPNLVFKLKQGKEPWVLEVEFPRRRCPEELWN

SEQ ID NO: 592 - protein, 81 aa, Mus musculus
KPWAVNFADVAVYFSPEEWRYLRPAQRALYREVMRETYGLLAYLDVGCAKPALICWVEEESEVWGPCAQDPEVAMCRTEVH

SEQ ID NO: 593 - protein, 81 aa, Peromyscus maniculatus
MEEMLSFRDVAIDFSAEEWECLDLAQWNLYRDVMLENYSNLVFLGLASCKPYLVTFLEQRQGPSDVKRQAAAPVHPGGTPY

SEQ ID NO: 594 - protein, 81 aa, Peromyscus maniculatus
NAVTYNDVHVDFTQEEWALMDPSQRNLYKDVMVETYMNLTAIGYNWEDLEVEEHCQNSLKHGRHKRPHTTEKSCEYMGCGK

SEQ ID NO: 595 - protein, 81 aa, Peromyscus maniculatus
TENAVTYDDVHVGFTWEEWALLDPSQKNLYKDVMLDTYRNLTTIGYSWEGHNIEEHFQSSRRHERHKRSDTGENSSVYTQC

SEQ ID NO: 596 - protein, 81 aa, Ictidomys tridecemlineatus
EPGAVSFADVAVYFSPEEWGCLRPAQRVLYRDVMRETYGHLGALGFPGPKPALISWMEQESEAWSSAAQDPEEGESLGGAL

SEQ ID NO: 597 - protein, 81 aa, Marmota monax
FQESVTFRDVAIAFSQQEWQSLDSSQRDLYRDVMLENYRNLVSLGHSLSKPHVITLLEQWKDPWETGRKDKRRRCADLQLE

SEQ ID NO: 598 - protein, 81 aa, Dipodomys ordii
KPGAVSFADVAVYFSPEEWGCLRPAQRALYRDVMRETYGHLGALGLPGPKPALISWMEGESEAWNPAAQDPEEGENLGGAL

SEQ ID NO: 599 - protein, 81 aa, Fukomys damarensis
EPWAITFADVAVYFSPEEWGCLQPTQRALYRDVMRDTYVLLSALGGGGGAKPALISWVERESELWDSDAQDPEVPKWPTEA

SEQ ID NO: 600 - protein, 81 aa, Marmota monax
AQESVMFSDVSIDFSQEEWECLTDDQRHLYRDVMLENYSNLVSMGHSISKPNVISYLEQGKEPWLVDRGRTRGQWPVLEST

SEQ ID NO: 601 - protein, 81 aa, Dipodomys ordii
LASISFEDLAVTFTEEEWEHLDLGQRNLYQEVMLETYQLLVSLGDQVRLAPPTPGTPLPALPAQPRLLGLPSQPLDRRGTP

SEQ ID NO: 602 - protein, 81 aa, Ictidomys tridecemlineatus
VPEPVTFEDVAVDFTQEEWGQLDLVQRTLYRDVMLETYGHLLSVGNQIAKPEVISLLEQGEEPWLVEQTCPESSCPEWMRD

SEQ ID NO: 603 - protein, 81 aa, Mesocricetus auratus
MEELLSFPDVAIDFSAEECECLDLAQWNLYKEVMLENYSNLVFLGLSFSKPYLVTFLEQSSEPWSVKRKSAAASHPGSKPH

SEQ ID NO: 604 - protein, 81 aa, Mesocricetus auratus
DMGLVSFEDVAVDFTWQEWQELDAAQRTLYRDVMLENYSSLVSLGNCLDKPELISKLEQGLVPWSGAEATEQYQPDVHKWS

SEQ ID NO: 605 - protein, 81 aa, Dipodomys ordii
SQGLVTFEDVAVYFSLEEWERLNVEQRALYQEVMQGNYGILVSLGYPIPKPDLIFRLEQGEEPWVPDSPHPEEGDIVTGVY

SEQ ID NO: 606 - protein, 81 aa, Octodon degus
VTFEDVAVNFSREEWALLDPPQRKLYRDVMWETLRHLAAVDDQQSEDEFRNFQKRVRSEEVEKASQYTLWYQHGEMDSRTP

SEQ ID NO: 607 - protein, 81 aa, Octodon degus
QGSVTFEDVAVHFSWDEWHLLDKAQRCLYRDVMAENLALITSLGLWPGVGDAEASSEQSASLKGMSQVRTFREGLSPQRAQ

SEQ ID NO: 608 - protein, 81 aa, Mus caroli
MGLVSFEDIAVYFNLEEWQDLDTAQRTLYRDVMLETYSSLVFLDPCIAKPKLIFNLERGFGPWSLAEASSRSLPGVHNVST

SEQ ID NO: 609 - protein, 81 aa, Mus musculus
GCCSLETHSIRDKNAVTYGDVHVNFTQEEWALLDPSQKKLYKDVMLETYRNLNAIGFNWDDKNTEEHCPSTRRWRRFYRMQ

SEQ ID NO: 610 - protein, 81 aa, Octodon degus
SQGSVSFKDVTVGFTQEEWQHLDPSQKSLYRDVMLENYSHLVSVGYCVTKPELIFRLEQGEEPWVLEEEFPRPGFLEFWKT

SEQ ID NO: 611 - protein, 81 aa, Mesocricetus auratus
LQDSVTFKDVAVDFSQEEWERLNPAQRSLYRTVVLENYWNLVSVGACVSKSHLISLLEHGKAPWDMRGEVTESTSQDGESV

SEQ ID NO: 612 - protein, 81 aa, Dipodomys ordii
AVTQLTFEDVAVDFTQEEWRCLTQAQRTLYRDVMLDTYGNLVSVGVSPPSMSVILPLEFQEDPWVAKSHVTTPGELNGWEG

SEQ ID NO: 613 - protein, 81 aa, Octodon degus
VHGSVTFRDVAIDFCQEEWECLGPIQRDLYRDVMLENYSNLIAVGSTISKPDVIALLEQGTEPWMGVRKDRSRWYPGLNSG

SEQ ID NO: 614 - protein, 81 aa, Dipodomys ordii
AVTQLTFEDVAVYFTREEWRCLTPAQRTLYRDVMLDTYRNLVSVGVSPPSMSVILPLEFQEEPWVAQSHVTTLGGLNGWEG

SEQ ID NO: 615 - protein, 81 aa, Octodon degus
SPVLVSFDDVFVSFTREEWQVLDNAQRALYGDVMLETYRSLVLLGQCITKPEVIFKLEQGVEPWTGGEPHNQSPPDVQEVD

SEQ ID NO: 616 - protein, 81 aa, Cricetulus griseus
KPGAVSFADVAVYFSPEEWGCLRPAQRALYREVMRETYGLLGALGVGGAKPALISWVEEEAELWGPGAQDPEVAMCQTQAD

SEQ ID NO: 617 - protein, 81 aa, Mus caroli
PKVTVSFEDVSVYFTKTEWKLLDLKQRNLYKQVMLENYSHLVSVGFAFSKPNLVSQLERGEKPWIRDDRMESAARSRAGNR

SEQ ID NO: 618 - protein, 81 aa, Mus caroli
MEDLLSFTDVAIDFSADECECLDSAQWNLYKEVMLENYSNLVFLGLAFSKPHLVTFLEQSSDPWSVKRKASAAISLGSKPH

SEQ ID NO: 619 - protein, 81 aa, Mus caroli
LQEAVTFNDVAIDFSQEEWEWLNSAQRSLYRTVVLENYRNLVSVGACISKPSLISLLEHGKEPWEVKGQVTGSRVQGGESV

SEQ ID NO: 620 - protein, 81 aa, Marmota monax
AHGSVTFRDVAMDFSQQEWECLNPFQKTLYRDVMMENYGNLVSLGHSISKPDVITLLEQGKEPWMIVKKETRKWRKDLESR

SEQ ID NO: 621 - protein, 81 aa, Mus caroli
FKELVVFRDVAVEFCKEEWECLGPEQRSLYRDVMLENYSNFVSLGLAISKPTIISLLEQGKEPWIVEQAGWYPDLLSENEA

SEQ ID NO: 622 - protein, 81 aa, Mus musculus
FQVPVTFRDVAVYFCREEWECLSPSQRTLYRNVMLENFRNLNELGCCSRRPGLITRLEQWDEPWVDDWDRSEFPDGQKSFC

SEQ ID NO: 623 - protein, 81 aa, Ictidomys tridecemlineatus
EPGAVSFADVAVYFSLEEWGCLRPSQRALYRDVMRETYLHLSALGGGGTKPALISWVEEEAELWHPDAQDPEVAKCPTEAD

SEQ ID NO: 624 - protein, 81 aa, Heterocephalus glaber
QGSVMFSDVSIIFSQEEWEYLDREQRNLYRNVMMENYSNLVSLAGCFISKPDVITLLEQGKDPWKVVRKGRKRYSDLETSH

SEQ ID NO: 625 - protein, 81 aa, Mus caroli
MDAVTFMDVHVNFSQEEWALLNPSQKSLYKDVMLETYWNLTCIGYEWEDHNSEECCQSSRRHGRYFNSSQYSTCKAKGYGK

SEQ ID NO: 626 - protein, 81 aa, Mus musculus
MDAVTYEDVHVNFSREEWVLLDPSQKSLYKDVMLETYWNLTCIGYKWKDHDNEEYCQNSGRHGRCINCPSAYGKKQCTNLF

SEQ ID NO: 627 - protein, 81 aa, Cricetulus griseus
EKQFSFQSLLTFEDVAINFSKKEWECLDTSQRDLYRFVMLENYSNLVSVGLSVSKPELVTCLEQNKEPWMVNIEESEVLEP

SEQ ID NO: 628 - protein, 81 aa, Mesocricetus auratus
SKAPVTFGDLVIYFSQEEWEWLSPIQKDLYEEVMLENYHTLVSLGLVSRRPNIITLLEKGKAPWMVEPSRRRRGPESGSKR

SEQ ID NO: 629 - protein, 81 aa, Mesocricetus auratus
MDAVTYDDVHINFTLEEWALLNPSQKSLYKDVMLDTYRNLTAIGYSWDDHNIEEICQSSRSHRRHLQRHAKINTGEKPYGS

SEQ ID NO: 630 - protein, 81 aa, Marmota monax
TEGPLTFRDVAIEFSQEEWKFLVPAQRALYRDVMLETYRNLVFLGTCPSDLSVLSWLEQGRELWTVNGPEEISRPANEWAC

SEQ ID NO: 631 - protein, 81 aa, Mus caroli
TQRSISFKDLAVDFTREEWQRLGPAQRLLYRDVMLENYSNLIAVGLHVSKPDVILKLEQGKEPWVVENSSRQNHAEDDEPL

SEQ ID NO: 632 - protein, 81 aa, Mus caroli
MEDPLSFTDVAIDFSADECECLDSAQWNLYKEVMLENYSNLVFLGLAFSKPHLVTFLEQSSDPWSVKRKASATIPLGSKPH

SEQ ID NO: 633 - protein, 81 aa, Rattus norvegicus
FQDLLSFTDVAIDFSADECECLEPAQWNLYKEVMLENYSNLVFLGLAFSKPYLVTFLEQSSDPWSMKRKASAAIHLGLKPH

SEQ ID NO: 634 - protein, 81 aa, Rattus norvegicus
DVVTYEDVHVNFTQEEWALLDPSQKRLYKVVMLETYKNLSAIGYIWEDHTIEQHFQSSRSHGRHKRHRTGEQPSELIQHGK

SEQ ID NO: 635 - protein, 81 aa, Octodon degus
LLPAAGCGKDSGTPATEAVTFEDVAVNFSREEWALLDPPQRKLYRDVMWETLRHLAAVGMNSDDRQIEDVYKICRKNLSGA

SEQ ID NO: 636 - protein, 81 aa, Mus caroli
PITFDDVAIIFSPEEWECLDSAQRDLYRDVMVENCRNLLSVEASRHGTKGFSSKKDMKRSFQEELSRRLSKCGADIFHPRK

SEQ ID NO: 637 - protein, 81 aa, Mus musculus
MNAVTYRDVHVNFTQEEWALLDPSQKKLYKDVMLETYRNLNAIGFNWEAQNIEEHCQSSRRHRRCERSQSAEKPSEYTQRD

SEQ ID NO: 638 - protein, 81 aa, Octodon degus
RPRALKFADVAVYFSPEEWGCLRPAQRTLYRDVMRETYGHLGALGCAGPKPALISWLERNTDDWEPAALDPQEYPRGVTVQ

SEQ ID NO: 639 - protein, 81 aa, Mus musculus
MDALTFDDVHVHFTREEWSLLDPSQKRLYKDVMLEIYKNLTAIGYKWKDHNVGEHSQNDRRYGRHERSPAGENHNEYTQCD

SEQ ID NO: 640 - protein, 81 aa, Fukomys damarensis
VTFDDVAVNFTMEEWALLDPSQKKLYRDVMWENFRNVTAIGRNWDNQQIEDQYKNYRNNLRKTSADFQSLQKHAMTNPEEK

SEQ ID NO: 641 - protein, 81 aa, Peromyscus maniculatus
FQSEVMFRDVTVNFSQEEWECLNSYERDLYKDVMLENYSHLVSLGCSISKPDVITLLEQGKEPWMIVRDERRRWSQDLETR

SEQ ID NO: 642 - protein, 81 aa, Ictidomys tridecemlineatus
AHESLAFRDVAIDLSQEEWECLDTAQRDLYREVMLENYSNLISLGCIIPKPDVIVLLEQEKDPWLETREETRRRSSDFTKK

SEQ ID NO: 643 - protein, 81 aa, Mus caroli
AHSMVMFRDVTVDFSQEEWECLSSYERDLYRDVMLENYSHLVSLGCSISKPDVITLLEQGKEPWMIVRAEKRRWSRDLESR

SEQ ID NO: 644 - protein, 81 aa, Octodon degus
PTAPVAFSDLTICFSQEEWGWLSPTQKLLYEEVMLENYQNLVSVGLCTRKPHIITLLEKGKDPWIAEPLRKRGGPDPASRY

SEQ ID NO: 645 - protein, 81 aa, Octodon degus
EPWAVTFADVAVYFSSEEWRCLRPAQRALYRDVMRDTYGLLSALGGGGTKPALISWVEGEAELWDPDAQDPEVVRWPAEAD

SEQ ID NO: 646 - protein, 81 aa, Mus musculus
SQVSLTFEDVAVLFTRDEWKKLVPSQRSLYREVMLENYSNLASLAGFPFTKPKVISLLQQGEDPWKVEEEGPGGFSLGLKC

SEQ ID NO: 647 - protein, 81 aa, Mustela putorius
PQKSVTFEDVAVYFTQTEWDGLSPAQRALYRDVMLENYGNVASLGFSLLKPAVISQLEGAGELGRPSPLVAGTEIGLQGLW

SEQ ID NO: 648 - protein, 81 aa, Delphinapterus leucas
FQGSVSFKDVTVDFSREEWQQLDLAQKSLYRDVMLENYFNLISVGCQVPKPEVIFNLERGEQPCMLDGEISSQSYLDQGIG

SEQ ID NO: 649 - protein, 81 aa, Delphinapterus leucas
AQGLMAFEDVAVYFSREEWGLLDAAQRALYRRVMLENFTLLASLGLSVSRPHVVIQLECGKEPWVLNGTDVTLARNAQRRP

SEQ ID NO: 650 - protein, 81 aa, Vicugna pacos
SQGSLSFRDVTVGFTWEEWQQLDPAQRALYRDVMLETYSHLLSVGYCIPKPEVILKLEQGEEPWILEEESSSQSVPELINS

SEQ ID NO: 651 - protein, 81 aa, Odobenus rosmarus
SHGPLSFEDVAIAFTKEEWQQLDPAQRTLYRDVMLENFSHLVSLGHPVSKPDIISRLEQGEEPWIIKRDISDWICPERETR

SEQ ID NO: 652 - protein, 81 aa, Vicugna pacos
AQGSVMFSDVSIDFSQEEWECLNDDQRDLYRDVMLENYSNLVSMGHCISKPDVISFLEQGKEPWLVDREPTRYQWPVLESR

SEQ ID NO: 653 - protein, 81 aa, Odobenus rosmarus
SQEPVTFEDVAVYFTQNQWASLDPMQRALYLEVMLENYANITSLAALPFPKPDLILQLEQGEAPWGLDPWTPLEREALGGV

SEQ ID NO: 654 - protein, 81 aa, Delphinapterus leucas
SQESVSFEDVAVYFTRNQWASLDSAQRTLYREVMLENYANVTSLAAFPFPKPDLIFQLERGKAPGGLDPWTPIRREVRGVC

SEQ ID NO: 655 - protein, 81 aa, Carlito syrichta
SKDLVTFGDVAVNFSQEEWEWLNPAQRNLYRRVMLENYRSLVSLGVSVSKPDVISLLEQGKEPWMVKKEGTRGACPDWEYV

SEQ ID NO: 656 - protein, 81 aa, Vicugna pacos
RPESVTFEDVAIYFSENEWTGLAPAQRALYRDVMLENYGALASLAAFPFPKPALIFQLEQGEAPWSSAPQGALDGEGPRGI

SEQ ID NO: 657 - protein, 81 aa, Delphinapterus leucas
SQEAVTFEDVAVNFSNEEWQCLTHAQRHLYKDVMLENYGNVVSLGFPFPKPPLISHLEQEAELCVQDGQDREFLSCSHPVS

SEQ ID NO: 658 - protein, 81 aa, Delphinapterus leucas
FQGSLSFRDVAVGFTRKEWQQLDPTQRTLYRDVMLENYSHLVSVGCQVTKPAVISRLEQGQEPWMKEEEILRWSFPEVLQV

SEQ ID NO: 659 - protein, 81 aa, Cervus elaphus
SHTLVTFKDILVNFTREEWKLLDTAQQIMYKDVMLENYRNLVSLGHQLPKPDVILRLEKGEEPWLVEKEIHQETHPDLETP

SEQ ID NO: 660 - protein, 81 aa, Vicugna pacos
ALESVTFRDVAVFFSRDEWLHLNPAQRALYREVMLDNYSALLSLGILFSKPKVILQLEQGEDPWMVENGVSQSACLGWESL

SEQ ID NO: 661 - protein, 81 aa, Odobenus rosmarus
EELPVVFEDVAVYFTREEWGMLVKRQKELYRDVMRMNYELLASLGPAAAKPDLISKLERRAAPWIKDPNGPKWGKGRPPGK

SEQ ID NO: 662 - protein, 81 aa, Carlito syrichta
SQGLVTFGDVALDFSQEEWEWLNPSQKDLYRDVMLENYRNLVWLGLSISKPNMISLLEQGKEPWMVEREMSHGQCADWESW

SEQ ID NO: 663 - protein, 81 aa, Delphinapterus leucas
FESVVFEDVAVDFTPEEWALLDPAQRNLYRDVMLETFRNLASVGENWKCHSIEDQHKNQGTHLRWRVVEIPSENNESNQCG

SEQ ID NO: 664 - protein, 81 aa, Delphinapterus leucas
AQESVMFSDVSIDFSQEEWEYLNDDQRDLYREVMLENYSNLVSMAGHSISKPDVISFLEQGKEPWLVDRELTRDQWPVLES

SEQ ID NO: 665 - protein, 81 aa, Ornithorhynchus anatinus
AQVPVTFEDVAVYFSREEWAALDGRQKELYRDVMRGNYELVASLGCPAAKPDLICQIERDEELGVGEPQGRPVRRQPQRRS

SEQ ID NO: 666 - protein, 81 aa, Odobenus rosmarus
QAEVTFEDVAVLFSREEWGRLSPAQRGLYRDVMLETYRNLVSLGAGPAGPKPGVITQLERGDEPWVLDAQGAKGKERLRVS

SEQ ID NO: 667 - protein, 81 aa, Colobus angolensis
RLESVTFEDVAVYFTQNQWASLNPAQRALYGEVMLENYANVASLVAFPFPKPALISHLERGEAPWGPDPWDTKIPRGIGQG

SEQ ID NO: 668 - protein, 81 aa, Colobus angolensis
SKAPITFGDLAIYFSQEEWEWLSPIQKDLYEDVMLENYRNLVSLGLSFRRPNVITLLEKGKAPWMVEPVRRRQAPDSGSKC

SEQ ID NO: 669 - protein, 81 aa, Odobenus rosmarus
RPRAVKFADVAVYFSPEEWGCLRPAQRALYRDVMRETYGHLGALGCAGPKPALISWLERNTDDWEPAALDPQECPRGLTVQ

SEQ ID NO: 670 - protein, 81 aa, Erinaceus europaeus
RSEALSFADVSVSFSREEWGCLRPAQKALYRDVMRETCGLLGALGLSGPKPAFISWLEGEMEAWSPEAHEPERESRAADAR

SEQ ID NO: 671 - protein, 81 aa, Mustela putorius
PKVPVSFEDVSVYFTKTEWKLLDVQQRILYKTVMLENYHHLVSLGCLSTKPHLVSWLEQGEGPWTTDIWRTPATAKTQTEG

SEQ ID NO: 672 - protein, 81 aa, Mustela putorius
SSVTFEDVAVYFSQEEWRFLNKAQKHLYHDVMLEVFALIASLGGGQGALEAAAPSEQNVSGGGSQKAYAQDCSLDTNPGQT

SEQ ID NO: 673 - protein, 81 aa, Erinaceus europaeus
SQASVSFKDVTVEFTQDEWRLMSSAQRTLYREVMLENYSHLISMGYCSTKPELIFALEQKDFRESILERESLSTIPPEDFQ

SEQ ID NO: 674 - protein, 81 aa, Vicugna pacos
PQKSVTFEDVAVYFTQTEWDGLSPAQRALYRDVMLENYGNVASLGFPLLKPAVISQLEGGGKLGGPSPLASGTGTGPQGLW

SEQ ID NO: 675 - protein, 81 aa, Vicugna pacos
RPRAVKFADVAVYFSPEEWECLRPAQRALYRDVMQETYGHLGALGCAGPKPALISWLERNTNDWELAALDPQECPRQMTVQ

SEQ ID NO: 676 - protein, 81 aa, Odobenus rosmarus
KPGAVSFADVAVYFSPEEWGCLRPAQRALYRDVMRETYGHLGALGFPGPKPALISWMEQESEAWSPAAQDPEEGESLGGAL

SEQ ID NO: 677 - protein, 81 aa, Cervus elaphus
VFDAVTFTDVAVDFSQDEWERLTLAQRTLYKKVMLENYSNLASLGLCISKPDVISSLEQDKEPWTMKGELTRGPCADLEYV

SEQ ID NO: 678 - protein, 81 aa, Chelonia mydas
AQMLVTFEEVAVYFTQGQGALLGPAQRALYRDVMQENYEMVTSLGFSLPKPELISRLERGEEPWVPDLQACEKRESLRGAR

SEQ ID NO: 679 - protein, 81 aa, Loxodonta africana
QESVTFKDVAVDFTQEEWHHMDPTQRILYRDVMLETYSHLVSLGYQVSKPEVIFKLEQGEEPWISEEEIQRPFCPDWEIRP

SEQ ID NO: 680 - protein, 81 aa, Suricata suricatta
TQDPVVFEDVAVDFTQEEWALLNLAQRNLYRDVMLENFQNLASLGYPLHIPYLISQWKQEEDLGTVERGTIQGEHQEGFET

SEQ ID NO: 681 - protein, 81 aa, Mandrillus leucophaeus
SKGSLMFRDVSIDFSQEEWECLDSGQMNLYKEVMLENFSNLVSVGLSSSKPAVISLLEQGKEPWMVDRELTRGLCSDLESM

SEQ ID NO: 682 - protein, 81 aa, Mandrillus leucophaeus
ACESITFGDVAIDFSHQEWEYLNLVQKTLYQEVMMENYDNLVSLGHFISKPDLITLLEQGKEPWMIVGEETRGECTDLDSR

SEQ ID NO: 683 - protein, 81 aa, Sus scrofa
AQESVMFSDVSIDFSQEEWECLNDDQRALYRDVMLENYSNLVSMAGHSISKPDVISFLEQGKEPWLVDRELTRGQWPVLES

SEQ ID NO: 684 - protein, 81 aa, Neophocaena asiaeorientalis
PQGCAISEDVFVYFSREEWVLLDEDQRLLYRDVMLENFALLASLGIASSRSHLVTQLEQGEEPWMPAQVDMTPATEKEAQK

SEQ ID NO: 685 - protein, 81 aa, Nomascus leucogenys
WPESVTFEDVAVYFTQNQWASLDPAQRALYREVMLENYANVASLVAFPFPKPALISHLERGEAPWGPDPWDTEIPRGISQG

SEQ ID NO: 686 - protein, 81 aa, Capra hircus
RPRAVKFGDVALYFSREEWGCLRPAQRALYRDVMQETYGHLGALGCAGPKPALISWLERNTDDWETAALDPQECPKGVAVQ

SEQ ID NO: 687 - protein, 81 aa, Chrysochloris asiatica
SLEQVSFKDVCVDFTQEEWYLLDPAQKILYRDVILENYSNIVSVGHCGTKPEVIFKIEQGEEPWVLGEGFSSLQHPERNWK

SEQ ID NO: 688 - protein, 81 aa, Mandrillus leucophaeus
KEASVAFRDVAVDFTQEEWRLLSPAQRTLHREVMLETYNHLVSLEIPSSKPKLIAQLERGEEPWREERKCSLDLCPESKPE

SEQ ID NO: 689 - protein, 81 aa, Sus scrofa
QAEVTFEDVAVLLSREEWGRLGPAQKGLYRDVMLETYRNLVSLGAGHAGPKPGVIAQLERGDEPWVLDMQGREQSTIDGSA

SEQ ID NO: 690 - protein, 81 aa, Nomascus leucogenys
FQEAVTFKDVAVAFTEEELGMLDSAQKKLYRDVMLENFRNLVSVGHQSFKPDMISQLEREEKLWMKELQTQRGKHSGEYCA

SEQ ID NO: 691 - protein, 81 aa, Nomascus leucogenys
MGLLTFRDVAIEFSLEEWQCLDTAQKNLYRNVMLENYRNLAFLGIAVSKPDLIICLEKEKEPWNMKRHEMVDEPPDICPHF

SEQ ID NO: 692 - protein, 81 aa, Bos indicus
TLESVTFQDVAVDFTQEEWALLDTSQRTLFREVMLENISHLVSVGNQLYKSDVISHLEQGEQLSREGLGFLQGQSPVISDR

SEQ ID NO: 693 - protein, 81 aa, Suricata suricatta
EEPPVVFEDVAVYFTREEWGTLVTRQKELYRDVMRLNYELLASLEPAAAKPDLISKLERRAAPWIRDPSGPKWGKGRPPGK

SEQ ID NO: 694 - protein, 81 aa, Chrysochloris asiatica
MLAPVTFEDVTVVFTEAEWVTLSTEQKNLYKEVTLETYRNLLSLAEPTPETYPGPSCLLPFSCQQFLSQHVLQIFPGVCAE

SEQ ID NO: 695 - protein, 81 aa, Mandrillus leucophaeus
FQGSISFKDVTVGFSQEEWQHLNPSQRALYRDVMLENYSNLVSVGYCVHKPEVISRLEQGEEPWRLEEEFPSQSFSEVWTA

SEQ ID NO: 696 - protein, 81 aa, Sus scrofa
MAFRDVAVAFSQKEWKLLSPAQRTLYRDVMLENYSLLVSLGIAFPKPKLITQLEQGDEPWREESECFLDLYSEPRTEFQPC

SEQ ID NO: 697 - protein, 81 aa, Neophocaena asiaeorientalis
EEVPVVFEDVAVYFTREEWGTLDKRQKELYRDVMRMNYELLASLGPAAAKPDLISKLERRAAPWIKDPNGPKWGKGRPPGK

SEQ ID NO: 698 - protein, 81 aa, Nomascus leucogenys
RQAFLAFGDVTVDFTQKEWRLLSPAQRALYREVTLENYSHLVSLGILHSKPELIRRLEQGEAPWGEERRRRPGPCAGIYAE

SEQ ID NO: 699 - protein, 81 aa, Nomascus leucogenys
SVAFEDVAVNFTQEEWALLSPSQKNLYRDVMLETFRNLASVGIQWKDQNIENLYQNLGIKLRSLVERLCGPQEGSEHRETF

SEQ ID NO: 700 - protein, 81 aa, Capra hircus
IKSPLTFGDVAVEFSGEEWAWLDSAQRSLHRSVMLENYRNLASLGLCLSKPEMISSLEQRKEPWAVKRKSTSGKCPDLQTL

SEQ ID NO: 701 - protein, 81 aa, Capra hircus
SQVSVTFEDVAVLFTRDEWRKLAPSQRNLYQDVMLENYSNLVSLGLPFSKPEVISLLQQGEDPWKVEKESPGGSSLGEWSS

SEQ ID NO: 702 - protein, 81 aa, Sus scrofa
EEVPVVFEDVAVYFTRDEWGTLDKRQKELYRDVMQMNYELLASLGPAAAKPDLISKLEQRAAPWIKDPHGPTWGKGRPPGK

SEQ ID NO: 703 - protein, 81 aa, Sus scrofa
SQSSVTFGDVAVDFSQDEWAWLDATQRSLYRSVMLENYRNLVSLGLCSSKPDMISSLEQRKEPWTVKRKLPGGGCPDPQAV

SEQ ID NO: 704 - protein, 81 aa, Suricata suricatta
KPGAVSFADVAVYFSPEEWGCLRPAQRALYRDVMRETYGHLGALGFPGPKPALISWMEQESEESEAWSPAAKDPEEGESLG

SEQ ID NO: 705 - protein, 81 aa, Suricata suricatta
THGLVMFKDVAIDVSQEEWECLNPTQRSLYRDVMLENYSNLVSLGLSLSKPAVISSLEQGMEPWMVVREVTGKQCPDLVSR

SEQ ID NO: 706 - protein, 81 aa, Suricata suricatta
SKLPVTFGDLAIYFSQEEWEWLSPIQKDLYEDVMLENYQNLVSLGLSFRRPNVITLLEKGKAPWMVEPVRKRRGLDSKSKC

SEQ ID NO: 707 - protein, 81 aa, Mandrillus leucophaeus
MAFEDVAVYFSQEEWGLLDTAQRALYRRVMLDNFALVASLGLSTSRPRVVIQLERGEEPWVPSRTDTILSRNTYRRRNPGS

SEQ ID NO: 708 - protein, 81 aa, Sus scrofa
ALGSVTFRDVAVFFSQDEWLHLDSAQKTLYQEVMLENYSTLVSLGIPFSMPKVICQLQQGEDPCMVEGEALRDPCLDFKTW

SEQ ID NO: 709 - protein, 81 aa, Sus scrofa
VTFEDVALYFSRDEWRLLDEAQRRLYHDVMLQNFSLISSLGCCCGAEDAESPFQPSMFRDVSQARTLKAASLSQKNHPCEK

SEQ ID NO: 710 - protein, 81 aa, Nomascus leucogenys
GKELLSFEDVAMYFTREEWGHLNLGQKDLYRDVMLENYRNMVLLGFQFPKPEVICQLENWDEQWILDLPRAGNRKASGSAC

SEQ ID NO: 711 - protein, 81 aa, Capra hircus
PKVPVSFEDVAMYFTKTEWKLLDHRQRKLYKQVMLENYHHLVSLGFSFAKPQLVIQLEQGQKPWVADVHRMRITTGMQAGD

SEQ ID NO: 712 - protein, 81 aa, Capra hircus
ARESVMFSDVSIDFSLEEWEFLNLEQRDLYRDVMLENYSNLVSLGCFISKPDVISLLEQGKEPWNVVRKGRRQYPDLETNY

SEQ ID NO: 713 - protein, 81 aa, Sus scrofa
AHGSVMFSDVSIDFSQEEWEYLNLEQRDLYRNVMLENYSNLVSLGCFISKPDVISLLEQGKEPWKVVRKGRRPYSGLETKK

SEQ ID NO: 714 - protein, 81 aa, Sus scrofa
AQGQVTFEDVAVCFSQEEWGLLDETQRLLYRSVMLETFSLMASLGLTSSRTHDISQLERWGEPFLSASGAMRATRPTGCWH

SEQ ID NO: 715 - protein, 81 aa, Nomascus leucogenys
MVQESVTFKDVAVLFTQEEWGQLSPAQRALYRDVMLENYSNLVSLGLLGPKPDMFSQLEKREVWMPEDTPGGFCLDWMTMP

SEQ ID NO: 716 - protein, 81 aa, Suricata suricatta
RPRAVKFADVAVYFSTEEWGCLRPAQRALYRDVMRETYGHLGALGCAGPKPALISWLERNTDDWEPAALDPQECPKRVTVQ

SEQ ID NO: 717 - protein, 81 aa, Suricata suricatta
DQESLTLEDVAVDFSREEWQLLAPAQKDLYRDVMLENYRNLVSLGYQASTPDALCMLERGEGPWATGEAVRGGARPETRKV

SEQ ID NO: 718 - protein, 81 aa, Suricata suricatta
KPGVLTFADVAVYFSSEEWGCLRPAQRALYRDVMRETYGHLGALGCAGPKPALISWLERNTDDWEPAALDPQECPKRVTVQ

SEQ ID NO: 719 - protein, 81 aa, Sus scrofa
VREPLTFEDVAVNFTQEEWQQLDPAQKTLHRDVMLEIYSHLVSVGCSGIKPDIISKLEHGEDPWIRESELPRWTYSDREKS

SEQ ID NO: 720 - protein, 81 aa, Neophocaena asiaeorientalis
PQVLVSFEEVAVLLSQEEWGHLGPDQKRLYRDVMLETYGNLVSLGLQGSKPDVISKLEQGEEPWAPHSPRIEGSWIWRRRR

SEQ ID NO: 721 - protein, 81 aa, Nomascus leucogenys
YQEMVTFEDVAVHFTKTEWTGLSPAQRALYRSVMLENFGNLTALGYPVPKPALISLLEGGDMDWGLEAQDDPPAERTKNVC

SEQ ID NO: 722 - protein, 81 aa, Equus caballus
WKELLSFEDVALFFTREEWNQLDWAQKDLYRDVMLENYRNLILLGFQFPKPEVICQLEQWEEPWILDLPRAGTRKASGSAC

SEQ ID NO: 723 - protein, 81 aa, Suricata suricatta
AQAPLSFEDVAVGFSPEEWQLLAPAQKDLYRDVMLENYRNLVSLGYQASKPDSLFQLEHGGPPWAVGGAAPRPPCAEEIWE

SEQ ID NO: 724 - protein, 81 aa, Mandrillus leucophaeus
PQGHLTFMDVAIEFSQEEWKCLDPGQRALYRDVMLENYRNLVSLGICLPDLSIISMLKQRREPLTLQSEVKIVKNPDGREC

SEQ ID NO: 725 - protein, 81 aa, Trichechus manatus
IHESVTFEDVAVNFTDREWQCLTHAQRHLYKDVMLENYGNMVSLGFPFPKPPLISHLERETEPWVQDLQDRESLSSFYPVS

SEQ ID NO: 726 - protein, 81 aa, Trichechus manatus
AHELVMFRDVAIDFSKEEWECLDLEQRDLYRDVMLENYSNMVLLGLCIHQPDMFSLLEKGKEPWKVLRYQTRGPCPDMQSR

SEQ ID NO: 727 - protein, 81 aa, Sus scrofa
AQESVMFSDVSIDFSQEEWECLNDDQRALYRDVMLENYSNLVSMGHSISKPDVISFLEQGKEPWLVDRELTRGQWPVLESR

SEQ ID NO: 728 - protein, 81 aa, Nomascus leucogenys
GSLTFRDVAIEFSLEEWQCLDTAQQNLYRNVMLENYRNLVFLGIAAPKPDLIIFLEQGKEPWNVKRHEMVEEPPVICSHFA

SEQ ID NO: 729 - protein, 81 aa, Zalophus californianus
GHALLTFRDVAIEFSQEEWGCLNHTQRELYRDVMLENYGHLLFLGLIVSKPDLVSFLEQTKDPWDGKRKKTVAFHPGLALS

SEQ ID NO: 730 - protein, 81 aa, Equus caballus
LQVSVSFEDVTVDFSREEWQHLDPAQRRLYRDVTLENYSHLCSVGYQVPKPEVIFKLEQGEGPWMLEGEAPHQSCSDDDIG

SEQ ID NO: 731 - protein, 81 aa, Loxodonta africana
VVFTDVAVDFSQEEWECLDSYQRSLYRDVILENYSNLVSLGGGSISKPDVVTLLEQGKEPWMVVRDTKIRWSLGLESNYDA

SEQ ID NO: 732 - protein, 81 aa, Chrysochloris asiatica
KPGIVRFADVAVYFSREEWACLRPAQRALYRDVMRETYGHLGALGFPGPKPALISWMERESEAWSPAAQEPKEGENLGGAP

SEQ ID NO: 733 - protein, 81 aa, Nomascus leucogenys
AQGYVTFEDVAVYFSQEEWRLLDEAQKLLYRNVMLENFSLLASLGLASSKTHEITQLESWEEPFMPAWEVVTSATPRGTWW

SEQ ID NO: 734 - protein, 81 aa, Capra hircus
MADLVMFRDVTVDFSQEEWECLNSNQRNLYRDVILENYSNLVSLGGCSISKPDVITLLEQGKEPWMVVRDEKRRWRLDLES

SEQ ID NO: 735 - protein, 81 aa, Suricata suricatta
SLEPDSFGDVAVLFSQEEWARLAPAQRELYRDVMLETYSHLVSLGLAVSKPDVISFLEQGKEPWLGEKAAAGGLGPELESR

SEQ ID NO: 736 - protein, 81 aa, Capra hircus
DLDQVTFEDVVVDFTREEWGCLEPAQRTLYRDVMLETFRLLVSVGHWLPKPDVISLLEQEAELWAADEGGPRGMCPDLETR

SEQ ID NO: 737 - protein, 81 aa, Sus scrofa
AHMAFRDVAVDFTQEEWMLLSPAQRSLYREVMLENYSNMVSLGIPFSKPKLITQLEQGKETWREERKCPPATCSAEPQPEL

SEQ ID NO: 738 - protein, 81 aa, Chlorocebus sabaeus
FQEPVTFEDVAVYFTQNEWASLHPTQRALYREVMLENYANVTSLLAFPFPKPALISHLERGEAPWGPDPWDTEIPRGISQG

SEQ ID NO: 739 - protein, 81 aa, Mandrillus leucophaeus
FQEAVTFKDVAVAFTEEELGLLDSAQRKLYRDVMLENFRNLVSVGHQSFKPDMISQLEREEKLWMKEFQTQRGKHSGFLCF

SEQ ID NO: 740 - protein, 81 aa, Neophocaena asiaeorientalis
KSKSKAPVTFGDLAIYFSQEEWEWLSPIQKDLYEDVMLENYQNLVSLGLSFRRPNVITLLEKGKAPWMVEPVKRRRGLGPL

SEQ ID NO: 741 - protein, 81 aa, Sus scrofa
FRGPVTFKDITVEFTQEEWQLLDNAQRTLYREVMQENYHHLISVGYCVNKPNAVFKLKQGKEPWILEVEFPRRNNPEDLWN

SEQ ID NO: 742 - protein, 81 aa, Canis lupus
SKVPVTFGDLAIYFSQEEWEWLSPIQKDLYEDVMLENYQNLVSLGLSFRRPNVITLLEKGKAPWVVEPVRKRRGLDSGFKC

SEQ ID NO: 743 - protein, 81 aa, Mandrillus leucophaeus
SKAPITFGDLAIYFSQEEWEWLSPIQKDLYEDVMLENYRNLVSLGLSFRRPNVITLLEKGKAPWMIEPVRRRRAPDSGSKC

SEQ ID NO: 744 - protein, 81 aa, Nomascus leucogenys
VQEPVTFKDVAVDFTQEEWGQLDLVQRTLYRDVMLETYGHLLSVGNQIAKPEVISLLEQGEEPWSVEQACPQRTGPEWVRN

SEQ ID NO: 745 - protein, 81 aa, Canis lupus
PQKSVTFEDVAVYFTQTEWDGLSPAQRALYRDVMLENYGNVASLGFSLLKPAVISQLEGAGELEGPSPLAAGTEIGPQGLW

SEQ ID NO: 746 - protein, 81 aa, Canis lupus
PKGLLTFRDVAIEFSQEEWGCLNHTQRELYRDVMLENYGNLLFLGLIVSKPDLVSFLEQKKEPWSVKRKKRVTIHPAQRFG

SEQ ID NO: 747 - protein, 81 aa, Muntiacus muntjak
RTGPLTFGDVAVEFSGEEWAWLDSAQRSLHRSVMLENYRNLASLGLCMSKPEMISSLEQSKEPWAVKAKSTRGRCPDLNLC

SEQ ID NO: 748 - protein, 81 aa, Mandrillus leucophaeus
FQEPVTFEDVAVYFTQNEWASLHPMQRALYREVMLENYANVTSLSAFPFSKPDLIFQLEQGEAAWGPDPWTLAGGEALRGM

SEQ ID NO: 749 - protein, 81 aa, Canis lupus
CEGSVSFEDVTMDFSREEWQQLDPAQRCLYQDVMLEIYSHLLFVGYNIPNPEIISRMEKGEEPWMREIQLPHQRHRERAFG

SEQ ID NO: 750 - protein, 81 aa, Sus scrofa
SQVTVTFEDVAVLFSRDEWRKLGPSQKNLYQDVMLENYSNLVSLGLPFSKPKVISLLQQGEDPWKVEKESPGSFSPGWKSS

SEQ ID NO: 751 - protein, 81 aa, Mandrillus leucophaeus
MEGLVMFQDLFIDFSQEEWECLDAAQKDLYRDVMMENYSSLVSLGLCIPKPDVISLLEQGKEPWMVSRDVLGGWCPDRLKK

SEQ ID NO: 752 - protein, 81 aa, Neophocaena asiaeorientalis
SQESVSFEDVAVYFTQNQWASLDSAQRTLYREVMLENYANVTSLAAFPFPKPDLIFQLERGKAPGGLDPWTPIRRKVRGVC

SEQ ID NO: 753 - protein, 81 aa, Neophocaena asiaeorientalis
AHGSVMFSDVSIDFSQEEWDYLDLEQRDLYRDVMLENYSNLVSLGCFVSKPDVISLLEQGKEPWKVVRKGRRRYPDLETNY

SEQ ID NO: 754 - protein, 81 aa, Bos indicus
PQESVTFEDVAVNFSHEEWQCLTHAQRHLYKDVMLENYGNMVSLGFSFSKPPLISRLEQGTEPYVQDRQDWEFLSCSYPVS

SEQ ID NO: 755 - protein, 81 aa, Canis lupus
SQESVTFRDVAIDFSQEEWEWLQPAQRDLYRHVMLENYSHLVSLGLNISKPYVVSLLEQGKGPWLEKGDVRRDLFSESHGE

SEQ ID NO: 756 - protein, 81 aa, Muntiacus muntjak
MAFEDVAVHFSQEEWGLLDTAQRSLYRRVMLENFALLASLGLSVSRPHVVTQLERGEEPWVLSGVDVTLPQDAQRRPRRGS

SEQ ID NO: 757 - protein, 81 aa, Canis lupus
SEESVTFEDVAIYFSENEWTGLAPAQRVLYRDVMLENYGAVAALAAFPFPKPALISQLERGEAPWCKAPQGALDGEGPRGI

SEQ ID NO: 758 - protein, 81 aa, Canis lupus
SQSLVTFGDVAVNFSQEEWEWLNSAQRNLYRSVMLENYRNLVSLGLCVSKPDMISSLEQRKEPWMVKRKLTRGRCPDLKAV

SEQ ID NO: 759 - protein, 81 aa, Mandrillus leucophaeus
NSGLLTFRDVAIEFSLEEWQCLDTAQKNLYRNVMLENYRNLAFLGVAVSKPDLITCLEKDKEPWNMKRHEMVDEPPGICPH

SEQ ID NO: 760 - protein, 81 aa, Canis lupus
FQEAVTFKDVAVVFSEEELGLLGPAQRKLYRDVMLENFRNLVSVGHSSSKPDVISQLEREEKLCTKEFHTQGGGRNQKEME

SEQ ID NO: 761 - protein, 81 aa, Muntiacus muntjak
EVQETLTFDDVAVAFTWEEWQLLAPAQKALYRDVMLENHSNLVSVGFQASTPEVLSKLDQGEPWTMDDEVHCRTRSEVWKF

SEQ ID NO: 762 - protein, 81 aa, Muntiacus muntjak
LLESVTFGDVAVVFSRDEWLHLDAAQRSLYREVMLENYSALVSLGIPLSIPKLICQLQQGEDPCMVEREIPQDVCLGFKTW

SEQ ID NO: 763 - protein, 81 aa, Muntiacus muntjak
MGLLTFQDVTVDFTQEEWECLDLGQRGLYRDVMLENYGNLACLGLVVSKPDLVTFLEQMKDPWNVRRIETAIYPGMCLLNI

SEQ ID NO: 764 - protein, 81 aa, Bos mutus
QEPVTFEDVAVYFTQNQWASLDSAQRALYREVMLENYANVASLVVSPFPRPDLISQLERGEAPWDPDPWEAEDLRGICPGG

SEQ ID NO: 765 - protein, 81 aa, Neophocaena asiaeorientalis
VQASLSFEDVAVRFTWEEWQLLDPSQKDLYRNVMLENYCNLVSVGYQTPKPDSLFQLEQGEPPWRVEGAGQSQTCPEEIWE

SEQ ID NO: 766 - protein, 81 aa, Canis lupus
AQVLVTFKDVAVTFTREEWGQLDLDQKALYQEVMLETYGLLVSLGHPVPKPELTHLLECGQELWKGKRGLSHSTCSGDDTK

SEQ ID NO: 767 - protein, 81 aa, Canis lupus
LQRLLTFRDVAIEFSQEEWTCLNHTQRKLYRDVMLENYGHLLFLGLIVSKPDLVSFLEQKKEPWSVKRKKRVTIHPGKVAQ

SEQ ID NO: 768 - protein, 81 aa, Neophocaena asiaeorientalis
AQGSLTLKDVAVDFTWEEWQLLDPDQKDLYRDVMLENYSNLVSVGYQVNKPDILSMLEQGEPPWTLEDEVHSHPHPETDKV

SEQ ID NO: 769 - protein, 81 aa, Nomascus leucogenys
SLGSELFRDVAIVFSQEEWQWLAPAQRDLYRDVMLETYSNLVSLGLAISKPDVISFLEQGKEPWMVERVVSRGLCPVLESR

SEQ ID NO: 770 - protein, 81 aa, Canis lupus
AQGSVMFNDVSIVFSQEEWEYLDLEQKDLYRDVMLENYSNLVSLGCFISKPDVISLLEQGKEPWKVVRKGRRRYLDLENRY

SEQ ID NO: 771 - protein, 81 aa, Muntiacus muntjak
RMKSVTFEDVAVYFTQTEWDSLSTAQRALYRDVMLENYGNVASLGFPLLKPAVISQLEGGGELEGPSPLASGAGTGPQGLW

SEQ ID NO: 772 - protein, 81 aa, Canis lupus
FQGSLTFSDVAIGFSQQEWECLDPVQKSLYRDVMMENYGNLVSLGYSISKPDVITLLEQGKEPWMVLREETKRWDTDSFLS

SEQ ID NO: 773 - protein, 81 aa, Bos mutus
QEQVSFKDVCVDFTQEEWYLLDPAQKILYRDVILENYSHLVSVGNCITKPEVIFKIEQGEEPWILEERFPKQWHSGKSYKY

SEQ ID NO: 774 - protein, 81 aa, Bos indicus
TQVSVTFDDVAVTFTQEEWGHLDPAQRTLYREVMLETCRLLMSLGCPVPRPELIYQQEHGQELWTVKRDLSRSTCAGYSSE

SEQ ID NO: 775 - protein, 81 aa, Muntiacus muntjak
GLVMFKDVAIDVSQEEWECLNPAQRNLYKDVMLENYSNLVSLGLSVSKPAMITSLEQGKEPWMVLREVTGERCPDLVSKCE

SEQ ID NO: 776 - protein, 81 aa, Nomascus leucogenys
PQESVAFEDVAVYFTAKEWDIMVPAERALYRDVMLENYEAVAFVVPPTSKPALVSHLEQGKESCFTRPQGVLCRNDWRAGL

SEQ ID NO: 777 - protein, 81 aa, Neophocaena asiaeorientalis
PQKSVTFEDVAVYFTQTEWDGLSPAQRALYRDVMLENYGNVASLGFPLLKPTVISQLEGGGELEGPSPLTSGTGTGHQGLW

SEQ ID NO: 778 - protein, 81 aa, Gorilla sp.
EPGAVSFADVAVYFCREEWGCLRPAQRTLYRDVMRETYGHLSALGIGGKKPALISWVEEEAELWGPAAQDPEVAKCPTQTD

SEQ ID NO: 779 - protein, 81 aa, Bos indicus
SVTFEDVAVYFSWEEWALLDEAQRCLYHDVMLENFALTSSLGCWHGAEDKGAPSEKSISVEGVSQIKTLKADSCPQKGQPF

SEQ ID NO: 780 - protein, 81 aa, Muntiacus muntjak
SVMFSDVSIDFSLEEWEFLNLEQRDLYRDVMLENYSNLVSLGCFISKPDVISLLEQGKEPWKVVRQGRRQYPDLETNYEIK

SEQ ID NO: 781 - protein, 81 aa, Nomascus leucogenys
SYEGSVSFRDVAIDFSREEWRHLDLSQRNLYRDVMLETYSHLLSVGYQVPEAEVVMLEQGKEPWALQGERPRHSCPGEKLW

SEQ ID NO: 782 - protein, 81 aa, Ailuropoda melanoleuca
QSLVTFGDVAVDFSREEWEWLNSAQRTLHRDVMLENYRNLVSLGLCVSKPDMISSLEQRKEPWMLKRKLTRGRCPDLKTMQ

SEQ ID NO: 783 - protein, 81 aa, Bos indicus
EELPVVFEDVAVYFTREEWGALDKWQKELYRDVMQMNYELLASLGPAAAKPDLISKLERRAAPWIRDPHGPKLGKGRPPPG

SEQ ID NO: 784 - protein, 81 aa, Ailuropoda melanoleuca
RPRAVKFADVAVYFSPEEWGCLRPAQRALYRDVMRETYGHLGALGCAGPKPALISWLERNTDEWEPAALDPRECPRGVTVQ

SEQ ID NO: 785 - protein, 81 aa, Gorilla sp.
AQTLLTFRDVAIEFSLEEWKCLDLAQQNLYRDVMLENYRNLFSVGLTVSKPGLITCLEQRKEPWNVKRQEAADGHPAMSSC

SEQ ID NO: 786 - protein, 81 aa, Muntiacus muntjak
QAEVTFEDVAVLLSQEEWGLLGPSQKGLYREVMLETYRNLLSLGAGLADPKPEVIVQLERGDELWVLDMHGAEQPSVDGSA

SEQ ID NO: 787 - protein, 81 aa, Muntiacus muntjak
QILESLTFQDVAVDFTREEWDQLYPAQKNLYRDVMLENYRNLVALGHQLYKPEVITQLEQEERWMMGRVSPPDTHPDGENR

SEQ ID NO: 788 - protein, 81 aa, Gorilla sp.
KSMVTFEDVAVYFSQEEWELLDAAQRHLYHSVMLENLELVTSLGCWHGVEGEEAHPEQNVSVEVLQVRIPNADPSTKKANS

SEQ ID NO: 789 - protein, 81 aa, Gorilla sp.
MALVTFRDVAIDFSQKEWECLDTTQRKLYRDVMLENYNNLVSLGYSGSKPDVITLLEQGKEPCVAARDVTGRQCPGLLSRH

SEQ ID NO: 790 - protein, 81 aa, Lynx canadensis
LLQESLTLEDVAVDFTQEEWRLLAPAQKDLYRDVMLENFRNLVSVGYVASMPAALSRLERGGRWMTEDETRRGICPEIKKD

SEQ ID NO: 791 - protein, 81 aa, Gorilla sp.
AQESITLEDVAVDFTWEEWQLLGAAQKDLYRDVMLENYSNLVAVGYQASKPDALFKLEQGEQPWTIEDGIHSGACSDIWKV

SEQ ID NO: 792 - protein, 81 aa, Ailuropoda melanoleuca
SDEAFSFEDLSVDFTQKEWQLLNPGQKDLYKDVMLENYSSLVSLGYEIMKPDVIFKLEQGEEPWIGDGEVPSSGCPADMSY

SEQ ID NO: 793 - protein, 81 aa, Gorilla sp.
FQEPVTFEDVAVYFTQNEWASLHPTQRALYREVMLENYANVTSLSAFPFPKPDLIFQLEQGEAAWGPDPWTLAGGEALRGM

SEQ ID NO: 794 - protein, 81 aa, Bos indicus
AQEPVTFNDVAVDFTQEEWGQLDLVQRTLYRDVMLETYGHLLSVGNQITKPEVISLLEQGEEPWSMEPAYPLQGTCPAPEI

SEQ ID NO: 795 - protein, 81 aa, Bos indicus
HSEGRLTFQDVAIDFTQEEWECLDPGQRKLYRDVMVENYRNLASLGLVSKVDLVTFLELLKDPRNIRRMKTTAIYPAVSPQ

SEQ ID NO: 796 - protein, 81 aa, Muntiacus muntjak
EPVTFEDVAVYFSQNQWASLDSAQRALYREVMLENYANVASLVSPFPRPDLISQLERGEAPWDPNPWEAEDLRGICPGGER

SEQ ID NO: 797 - protein, 81 aa, Muntiacus muntjak
AQVCVTFDDVAVTFTQEEWGHLDPAQRTLYQEVMLETCGLLMSLGCPVPRPELIYQLEHGQELWTVKRDLSGSTCPVDKGK

SEQ ID NO: 798 - protein, 81 aa, Macaca fascicularis
MVSFEDVAVLLSQEEWDCLIPAQRGLYRDVMLETYGNLVSLGLQASKPDVISRLEQGDKPWTPHILRTQISWSWRHKRECY

SEQ ID NO: 799 - protein, 81 aa, Myotis lucifugus
DAVTFPDVAIDFSRDEWECLNLAQRTLYRKVMLENYRTLVSVGLCVSKPDVISLLEQGEEPWVTDGEMAGGLCPHSECVWM

SEQ ID NO: 800 - protein, 81 aa, Phascolarctos cinereus
AQELVTFQDVAVDFTQEEWGLLDHPQKELYKEVMLENARNALSLGLPVPREGLISHFGQREAPWMMELEDPRTSYPVSQKL

SEQ ID NO: 801 - protein, 81 aa, Phascolarctos cinereus
GEEAVTFRDVALDFTWEEWGCLSAAQRELYKDVMLENYRNLVSLAGLPGPKPGLISWLEGEEEPHPWDSLVHAARSTSLSK

SEQ ID NO: 802 - protein, 81 aa, Myotis lucifugus
AQEPLTFHDVAVDFTWEEWQLLDPEQKDLYRDVMLETYSHLVSVGYEASKPDILSKLDHGEAPWTVAGEIHCGTHSEIWKR

SEQ ID NO: 803 - protein, 81 aa, Puma concolor
FQASVVFEDVAVKFTPEEWALLDRGQRKLYRDVMLETCRNLSSVEKQKFHSNGDLTRMQEGLLRSPLVESVCERIEGDQCG

SEQ ID NO: 804 - protein, 81 aa, Lynx canadensis
AHRSLMFSDVSIVFSQEEWEYLDLEQRDLYRDVMLENYSNLVSLGCFISKPDVISLLEQGKEPWKVVRKGRRRYADLETRY

SEQ ID NO: 805 - protein, 81 aa, Phyllostomus discolor
PQKLVTFEDVAVYFTPTEWDGLSPAQRALYRDVMLENYGNVASLGFPILKPAVISQLEGGGELGIPSLLAAGVGSDPPGLW

SEQ ID NO: 806 - protein, 81 aa, Oryctolagus cuniculus
SLGPVSFKDVAVGFTQEEWRQLEPAQRRTYREVMLENYSHLVAVGCHFIKPDVITKLERGEEPWIEGGFLPQGCADEVWQA

SEQ ID NO: 807 - protein, 81 aa, Desmodus rotundus
SQSLVTFGDVAVDFSQEEWEQLTCAQRALYRDVMLENYRNLVSLGLCFSKPDMISSLEQREEPWMAKRKLTRGPCPDWRAV

SEQ ID NO: 808 - protein, 81 aa, Macaca fascicularis
VKESVTFKDVAIDFTLEEWRLMDPTQRNLHKDVMLENYRNLVSLGLAVSKPDMISHLENGKGPWPKPATKNATRTKDISED

SEQ ID NO: 809 - protein, 81 aa, Phascolarctos cinereus
WQESLTFKDVAVDFTQEEWGLLDHSQKRLYKEVMLENSQNLLSLGIPPLREDLISHLEEGEASWILDRKGPRKSCPDAETR

SEQ ID NO: 810 - protein, 81 aa, Phascolarctos cinereus
EELPVVFEDVAVYFTREEWAMLDKRQKELYRDVMRMNYELLASLGPAAAKPELISKLERRAAPWIKDPNGPKWGKGRPPGK

SEQ ID NO: 811 - protein, 81 aa, Sapajus apella
VHGSVTFRDVAIDFSQEEWECLQPAQKTLYRDVMLENYSHLISLGSSISKPDVITLLEQEKEPWMVRRKETNRWYPDLESK

SEQ ID NO: 812 - protein, 81 aa, Macaca fascicularis
CYQDSVTFDDVAVDFTQEEWTLLDPTQRSLYSDVMLENYKNLATVGGQIIKPSLISWLEQEESRTVRGGVLQGRKTQWRGT

SEQ ID NO: 813 - protein, 81 aa, Macaca fascicularis
FQGSVSFEDVTVGFSQEEWQHLDPSQRALYRDVMLENYSNLVSVGYCVHKPEVIFRLEQGEEPWRLEEEFPSQSFPEVWTA

SEQ ID NO: 814 - protein, 81 aa, Macaca fascicularis
AQESVTFEDVAVNFTNREWQSLTYAQRHLYKHVMLENYGNMVSLGFPFPKPPLISHLERGVEPCVQDPQDRESLSCSYPVS

SEQ ID NO: 815 - protein, 81 aa, Phascolarctos cinereus
VGHPVTFRDVAVDFSLEEWRCLSPAQRALYRDVMLENYENLVSVGLPVSKPTVISLLEKGEAPWMPQAGAPRGPCPDYLSW

SEQ ID NO: 816 - protein, 81 aa, Phascolarctos cinereus
AQELVTFQDVAVDFTEEEWGLLDHSQKELYKEVMLENAQNLLSLGLPVTREDLISFFQKGEAPWILEPKGPWNFCPDAVTR

SEQ ID NO: 817 - protein, 81 aa, Oryctolagus cuniculus
SQSLVEFGDVAIDFSQEEWEWLNPAQRTLYRKVMLENYRNLASLGLCGSKPAVISSLEQGKEPWAVKRKVARGWSPDLKTV

SEQ ID NO: 818 - protein, 81 aa, Muntiacus muntjak
APVTFGDLAIYFSQEEWEWLSPIQKDLYEDVMLENYQNLVSLGLCFRRPNVITLLERGKAPWMVDPVKRRRGLDLGSKGET

SEQ ID NO: 819 - protein, 81 aa, Macaca fascicularis
DTVVFEDVVVGFTLEEWALLNPAQRNLYREVMLETFKHLASVDNEAQPKTNGSISQQDTSGEKLSLKQKIEKFTRKHTWAS

SEQ ID NO: 820 - protein, 81 aa, Macaca fascicularis
MAFEDVAVYFSQEEWGLLDTAQRALYRHVMLENFTLVTSLGLSTSRPHVVIQLERGEEPWVPSGKDMTLARNTYRRLNAGE

SEQ ID NO: 821 - protein, 81 aa, Macaca fascicularis
RPESVTFEDVAVYFSENEWIGLGPAQRALYRDVMLENYGAVASLAFPFPKPALISQLERGEAPWCSVPWGALDGEDPRSIS

SEQ ID NO: 822 - protein, 81 aa, Puma concolor
LQVSVSFEDVTVNFSREEWQHLDPAQRRLYRDVTLENYSHLRSVGYQVPKPEVIFKLEQGEGPWTLEGETPHQSCSGEDIG

SEQ ID NO: 823 - protein, 81 aa, Phyllostomus discolor
CWGLLSFKDISMDFTWEEWQLLDSAQKYLYRDVILENYRNLVSVGYHGTKPDLIFKLEQGEEPWIRNAKISRPRCSEGWKE

SEQ ID NO: 824 - protein, 81 aa, Phascolarctos cinereus
LQGSVTFQDVAVDFSWEEWGHLGPAQKELYREVMLENYGNLVCLGLAVSSPDVVCQLERGEGPWMPEGDVPGSSCAGWETK

SEQ ID NO: 825 - protein, 81 aa, Macaca fascicularis
PQGLVTFGDVAVDFSQEEWEWLNPNQRNLYRKVMLENYKNLASLGLCVSKPDVISSLEQGKEPWTVKRKMTRAWCPDLKIV

SEQ ID NO: 826 - protein, 81 aa, Phascolarctos cinereus
PLELVTFKDVAVDFSWEEWGHLEPSQKELYREVMLENYRNLVCLGLAISKPDVIFQLEQGEAPWMPEREGPKCRCADWKTR

SEQ ID NO: 827 - protein, 81 aa, Myotis lucifugus
PQKSVTFEDVAVYFTPTEWDGLSPAQRALYRDVMLENYGNVASLGFPLIKPAVILQLEGGGELGGPSPLAAETGTDPPGLW

SEQ ID NO: 828 - protein, 81 aa, Ursus maritimus
AKGLLTFGDVAIEFSQEEWECLSHTQRELYRDVILENYGHLLFLGVIVSKPDLVSLLEQRKEPWGEKRNKTRIHVGKNPFG

SEQ ID NO: 829 - protein, 81 aa, Ailuropoda melanoleuca
QAEVTFEDVAVLFSREEWGRLGPAQRGLYRDVMLETYRNLVSLGAGPAGPKPGVITQLERGDEPWVLDTQGAKGKERLRVS

SEQ ID NO: 830 - protein, 81 aa, Sapajus apella
PQKLVTFEDVAVYFTQAEWDGLSPAQRILYRDVMLENYGNVASLGFPLLKPAVISQLEGGGELGAPSPLAAGTGLHGLRTV

SEQ ID NO: 831 - protein, 81 aa, Ailuropoda melanoleuca
QGLLTFGDVAIEFSQEEWRCLSHTQRELYRDVMLENYGHLLFLGLIVSKPDLVSLLEQRKEPWDVKRKKTVVFDPAVSSHG

SEQ ID NO: 832 - protein, 81 aa, Macaca fascicularis
GKELLSFEDVAMYFTREEWGRLDWGQKDLYRDVMLENYRNMVLLGFQFPKPEVICQLENWDEQWILDLPRAGSRKASGSAC

SEQ ID NO: 833 - protein, 81 aa, Macaca fascicularis
HQEMVTFEDVAVHFTKTEWTGLSPAQRALYRSVMLENFGNLTALGYPVPKPALISLLEGGDMAWGLEAQDDAPAERTKNIC

SEQ ID NO: 834 - protein, 81 aa, Phascolarctos cinereus
SQIPLTFQDVAVDFTWEEWGLLEPSQKDMYWDVMLENYENFVSLGGIPVSFPDVISQMERIEAPWMTERGVLVSAFLDSPN

SEQ ID NO: 835 - protein, 81 aa, Sapajus apella
KPGAVSFADVAVYFSPEEWGCLRPAQRALYRDVMRETYGHLGALGFPGPKPALISWMEQESEAWSSAAQDPEKGESLGGAR

SEQ ID NO: 836 - protein, 81 aa, Oryctolagus cuniculus
EALPVVFEDVAVYFTREEWGMLDKRQKELYRDVMRMNYELLASLGPAAAKPDLISKLERRTAPWIKDPNGPKLGKGCPPGK

SEQ ID NO: 837 - protein, 81 aa, Desmodus rotundus
LQVSVSFEDVTVDFSREEWQHLDPAQRRLYWDVTLENYSHLLSVGYQVPKPEVILKLEQGEGPWTLEGETPHQSCSDEDIG

SEQ ID NO: 838 - protein, 81 aa, Macaca fascicularis
MTFEDVSVEFTQGEWGQLNPAQKDLYREVMLENFRNLAFLGLPVSKPYVICQLEEGGEPFIVEREVSTGAYSDWERRSKSK

SEQ ID NO: 839 - protein, 81 aa, Phascolarctos cinereus
PQASVTFEDVAVYLTQEEWGHLEPAQRGLYRDVMLENYGNVVSLGFPVSKPDVILQLELRGEPWFLDMQGTEGREILRDCE

SEQ ID NO: 840 - protein, 81 aa, Phascolarctos cinereus
QQGSVTFRDVAVDFTLEEWGHLDPFQKELYRDVMLENFRNLVCLGLTVSKPDVIHQLEQGEAPWIPEGESPRNSFAGCASD

SEQ ID NO: 841 - protein, 81 aa, Myotis lucifugus
VKFADVAVYFSPEEWGCLRPAQRALYRDVMRENYGHLGALGCAGPKPALISWLERNTEDWEPAALDPQDCPRGLMVQRKWP

SEQ ID NO: 842 - protein, 81 aa, Macaca fascicularis
FQGSVTFEDVAIAFSQQEWESLDSSQRGLYRDVMLENYRNLVSMAGHSLSKPHVIALLERWKEPKVTERKDGRRWCTDLQL

SEQ ID NO: 843 - protein, 81 aa, Phascolarctos cinereus
PQESVTFRDVAVDFTWEEWGQLDPSQKELYREVMLENYGNLACLGLAVSKPDVILQLERGEIPWMSERKVPEGICPDWEAR

SEQ ID NO: 844 - protein, 81 aa, Phascolarctos cinereus
LRESVTFKDVAVDFTGEEWRRLDPAQRALYRDVMLENYENLVSLGLPVSKLDVISLLERGEAPWWLEGGGLQSPCSDALSQ

SEQ ID NO: 845 - protein, 81 aa, Puma concolor
QAEVTFEDVAVLFSREEWGRLGPTQRGLYRDVMLETYRNLVSLGAGRAGPKPGVITQLERGDEPWVLDAQGAKGKGRPRVS

SEQ ID NO: 846 - protein, 81 aa, Oryctolagus cuniculus
SPESVAFEDVAVYFTKKEWASLLPAQRALYKEVMLENYGMVASLAPPPISKPALISQLEQGKEPWFTRPQGALNRRARRVV

SEQ ID NO: 847 - protein, 81 aa, Phyllostomus discolor
SRKPVSFADVAVYFSPEEWGCLRPVQRALYRDVMRETYGHLGALGFQDTKPALISWMEEEAELWGSDARDPELGECLSEDT

SEQ ID NO: 848 - protein, 81 aa, Macaca fascicularis
KPRTVSFADVAVYFSREEWGCLRPAQRALYRDVMRETYGHLGALGFPGPKPALISWMEQETEAWSPAAQDPEKGERLGGAR

SEQ ID NO: 849 - protein, 81 aa, Phascolarctos cinereus
CKESVTFKDVAVEFTWEEWVHLNSSQKTLYRDVMLENYRNLVSLGFAVSKPDVIYQLERKEASWIPGADIPRSSCPESKEF

SEQ ID NO: 850 - protein, 81 aa, Myotis lucifugus
FQGSVTFRDVAIDFSQEEWAWLQPAQRDLYRHVMLENYGHLVSLGLNISKPDVVSLLEQGKEPWLGKGDVRTDFFPVSESN

SEQ ID NO: 851 - protein, 81 aa, Sapajus apella
SQDLVTFKDVAIDFSQEEWQWMNPAQKRLYRSMMLENYQSLVSLGLCVSKPYVISLLEQGREPWEMTSEMTRSPFSDWESI

SEQ ID NO: 852 - protein, 81 aa, Ailuropoda melanoleuca
QEPVTFEDVAVYFTQNQWAKLDPTQRALYREVMLENYANVASLGVAFPFPKPDLVSQLERGEVPWGPDPWEAEVLRGICPG

SEQ ID NO: 853 - protein, 81 aa, Sapajus apella
FQGSISFKDVTVGFTQEEWQHLDPSQRALYRDVTLENYSNLVSVGYCVHKPEVIFRLEQGEEPWRLEEEFPSQSFPEVWTA

SEQ ID NO: 854 - protein, 81 aa, Phascolarctos cinereus
PQEPVTFKDVAVDFSQEEWGLLGPAQRHLYRDVMLENYRNLVSLGLILAKPEVVCHLEQGGELWKPEHGVLCSGDGELWVR

SEQ ID NO: 855 - protein, 81 aa, Puma concolor
PQEPVTFEDVAVLFTPEEWMFLDSAQRSLYRDVMLENYRNLASVGDQLGKFSSFSHLEQGEEWWPTERRVFPGSCPEPSLP

SEQ ID NO: 856 - protein, 81 aa, Macaca fascicularis
SQGSVTFRDVAIDFSQEEWKWLQPAQRDLYRCVMLENYGHLVSLGLSISKPDVVSLLEQGKEPWLGKRNVNRDLFSVSESS

SEQ ID NO: 857 - protein, 81 aa, Phascolarctos cinereus
QQGSVTFQDVAVDFSWEEWGHLGPTQKELYREVMLENYGNLVCLGLAVSSPDVVCQLERGEGPWMPEGDAPGSSRAGSSKH

SEQ ID NO: 858 - protein, 81 aa, Phascolarctos cinereus
TQDSVTFKDVAVDFTREEWERLNSTQRDLYRDVMLENYRNLVSLGLAVSKPDIIFQLEQEKELWMLKRKVLRSTRPAQKTE

SEQ ID NO: 859 - protein, 81 aa, Gorilla sp.
RPGAVSFADVAVYFSPEEWECLRPAQRALYRDVMRETFGHLGALGFSGPKPAFISWVEGEVEAWSPESQDPDGESSAAFSR

SEQ ID NO: 860 - protein, 81 aa, Ailuropoda melanoleuca
LQGLLTFRDVAIEFSQEEWGCLSHTQRELYRDVMLENYGHLLFSGLIASKPDLVSCLEQKKEPWDLKRKKTVAIHPVYELK

SEQ ID NO: 861 - protein, 81 aa, Phascolarctos cinereus
RQGSVTFQDVAVDFSWEEWGRLGPTQKELYREVMLENYRNLVCLGLEVSKPDVVYQLERGEAPWMPEGAVRRSCSQNWGAR

SEQ ID NO: 862 - protein, 81 aa, Phascolarctos cinereus
SAASVTFRDVAVDFSREEWSRLDAAQRALYRDVMWETYENLVSTGIPVSRLDVISLLAKQEAQWTPEEVPGWTSPDSFSEE

SEQ ID NO: 863 - protein, 81 aa, Puma concolor
SWASVVFEDVAVNFTPEEWALLNRGQRKLYRDVMLETCRNLSAVEKRKFHSSGDLTRMQEGLLRSPLVESVCERIEGDPCG

SEQ ID NO: 864 - protein, 81 aa, Lynx canadensis
AHGLVMFKDVAIDVSQEEWECLNPTQRSLYKDVMLENYSNLVSLGLSISKPAVISSLEQGKEPWMVVREVTGEQCPDLVSR

SEQ ID NO: 865 - protein, 81 aa, Macaca fascicularis
SYEGSVSFRDVAINFSREEWQHLDLSQRNLYRDVMLETCSHLLSVGYQVPKPEVVMLEQGKEPWALQGERPRQSCPGEKLW

SEQ ID NO: 866 - protein, 81 aa, Phascolarctos cinereus
GEEAVTFRDVALDFTWEEWGCLSAAQRELYKDVMLENYRNLVSLGLPGPKPGLISWLEGEEEPHPWDSLVHAARSTSLSKA

SEQ ID NO: 867 - protein, 81 aa, Phascolarctos cinereus
HQGSVTFGDVAVDFSQDEWGHLDPAQKELYREVMLENYGNLVCLGLAVSRPHVIEQLERGEAPWLPRGAVPRSCDLDWMTR

SEQ ID NO: 868 - protein, 81 aa, Phascolarctos cinereus
QASVTFRDVAVDFTGEEWRCLEPAQRALYRDVMLETYENLVFLGLSVPISKLDLIFLLERGGALSRPMGRVPSDSCPDSFI

SEQ ID NO: 869 - protein, 81 aa, Oryctolagus cuniculus
QAQEVLMFDDVAVRFTWEEWQLLNPAQKALYRDVMLENYRSLVSVGWRASKPDLLSQLERGEPWTIEGENHCGTPPEIWKA

SEQ ID NO: 870 - protein, 81 aa, Ailuropoda melanoleuca
RPGAVSFADVAVYFSPEEWGCLRPAQRALYRDVMRETYGHLGALGFAGPKPALISWLERKKEVWSPEAEDPEEGARHPGSG

SEQ ID NO: 871 - protein, 81 aa, Macaca fascicularis
AQESVMFSDVSIDFSQEEWECLNDDQRDLYRDVMLENYSNLVSMGHSISKPNVISYLEQGKEPWLVDRELTRGQWPVLESR

SEQ ID NO: 872 - protein, 81 aa, Phascolarctos cinereus
SQESLTFKDVAVDFTPEEWGQLYPAQRDLYREVMLENYRNLVSLGHQVSKPHLISQLEQRKEPWMMERKIPRGNFPDWETR

SEQ ID NO: 873 - protein, 81 aa, Sapajus apella
SQGLVTFGDVAIDFSQEEWEWLSPIQRNLYRKVMLENYRNLASLGLCVSKPDVISLLEQGKEPWTVKRRMTRAGCPDLKAV

SEQ ID NO: 874 - protein, 81 aa, Sapajus apella
AQESVTFEDVAVNFTDREWQCLTYAQRHLYKDVMLENYGNMVSVGFLFPKPPLISHLERGVEPCVQDPQDRESLSCSCLVS

SEQ ID NO: 875 - protein, 81 aa, Lynx canadensis
KPGALSFADVAVYFSSEEWGCLRPAQRALYRDVMRETYGHLGALGFAGPKPALISWMERKKEAWSPEAEDPEDRASRIRAK

SEQ ID NO: 876 - protein, 81 aa, Phyllostomus discolor
SQPPVSFKDVVVSFTREEWGQLDTVQRTLYRDVTLETCGHLVSLGLLLPNLDVISHLENGEDPWRAEQEPPTQDWKTTLEK

SEQ ID NO: 877 - protein, 81 aa, Phascolarctos cinereus
PQESVTFEDVAVDFTWEEWGYLDTSQKELYWEVMLENYKNLVSLGFVVAKPDAISQLEQEEAPWRPEVLFPRSSCSDLDTK

SEQ ID NO: 878 - protein, 81 aa, Phascolarctos cinereus
QEDPVTFQDVAVVFTQEQWGYLDPSQKELYRDVMLENYQNLLCLGLAVSKPEVICQLEQGEAPWRPEGRVPGSSHPDGEVR

SEQ ID NO: 879 - protein, 81 aa, Sapajus apella
SQELLTFKDISIDFTQEEWGQLTPAHQNLYREVMLENYSNLVSVAGYQLSKPVVISQLEKGEEPWMTEKEGPGDPSSDLKS

SEQ ID NO: 880 - protein, 81 aa, Macaca fascicularis
KPRTVSFADVAVYFSREEWGCLRPAQRALYRDVMRETYGHLGALGVGGSKPALISWVEEEAELWDPAAQDPEVTKCPTETD

SEQ ID NO: 881 - protein, 81 aa, Lynx canadensis
RPESVTFEDVAVYFSENEWIGLAPAQRVLYRDVMLENYGVVASLAFPFPKPALISQLERGEAPWCKAPQGALDGECPRGVS

SEQ ID NO: 882 - protein, 81 aa, Macaca fascicularis
KPGAVSFADVAVYFSPEEWGCLRPAQRALYRDVMRETYGHLGALGFPGPKPALISWMEQETEAWSPAAQDPEKGERLGGAR

SEQ ID NO: 883 - protein, 81 aa, Phascolarctos cinereus
PQEAVTFKDVVVDFTQEEWKCLDSSQKEFYRDVMLENYSNLVSLGLAFPKPYVIDQLERREAPWIPEGDIPRISHPERKKK

SEQ ID NO: 884 - protein, 81 aa, Phascolarctos cinereus
PRGLVTFKDVAVDFTQEEWGLLDHNQKELYKEVMLENARNLLSLGLPVPREDVISYFEQREAPWMLEQEGLRSRCLEGEIR

SEQ ID NO: 885 - protein, 81 aa, Phascolarctos cinereus
GQESVTFTDVAVDFTLEEWAYLDHFQKELYKDVMLENYRNLLCLGLAVSKPDVISQLEQGDAPWMSEGGVPRSIYSDWETR

SEQ ID NO: 886 - protein, 81 aa, Canis lupus
SHGPLSFEDVAVAFTKEEWQQLDPAQRTLYRDVMLENFSHLVSLGHPVSKPDVISKLEQGEEPWIIKRDIPNWIYPERENR

SEQ ID NO: 887 - protein, 81 aa, Macaca fascicularis
ALRSVMFSDVSIDFSPEEWEYLDLEQKDLYRDVMLENYSNLVSLGCFISKPDVISLLEQGKEPWKVVRKGRRQYPDLETKY

SEQ ID NO: 888 - protein, 81 aa, Ailuropoda melanoleuca
SKVPVTFGDLAIYFSQEEWEWLSPIQKDLYEDVMLENYQNLVSLGLSFRRPNVITLLEKGKAPWMVEPVRKRRGVDSGSKC

SEQ ID NO: 889 - protein, 81 aa, Lynx canadensis
RPRAVKFADVAVYFSTEEWGCLRPAQRALYRDVMRETYGHLGALGCAGPKPALISWLERNTDDWEPAALDPQECPRGVAVQ

SEQ ID NO: 890 - protein, 81 aa, Phascolarctos cinereus
MQESVTFKDVAVDFTQEEWKQLDPAQRDLYRDVMLENYRNLVSLGLPVFKPDVISQLEKGEAPWTPEVPRSTCSGSFSQEA

SEQ ID NO: 891 - protein, 81 aa, Bos mutus
KPLAVRFADVAVYFSPEEWGCLRPAQRALYRDVMQETYGHLGALGFPGPKPALISWMEQESEAWSPAAQDPEEGESLGGAL

SEQ ID NO: 892 - protein, 81 aa, Muntiacus muntjak
PQEPVTFADVAVLFTPEEWLFLDSAQKSLYRDVMLENYRNLASVGDQLCKTRMSSHMEQREELCVTERGVFPGAHLGPHLQ

SEQ ID NO: 893 - protein, 81 aa, Phascolarctos cinereus
FQESVTFKDVAVDFTWEEWGYLDTSQKELYWEVMLENYRNLVSLGLADSNVNMISQLESGEAHGISVDSVLRSCWPDGDTR

SEQ ID NO: 894 - protein, 81 aa, Lynx canadensis
GPWTLLTFRDVAIEFSQEEWGCLNHSQRELYRDVMLETYGHLLFLGLVSKPDLVILLEQKKELWGVKRKETVASHPGRWEI

SEQ ID NO: 895 - protein, 81 aa, Macaca fascicularis
FQGSVTFEDVAIAFSQQEWESLDSSQRGLYRDVMLENYRNLVSMGHSLSKPHVIALLERWKEPKVTDRKDGRRWCTDLQLE

SEQ ID NO: 896 - protein, 81 aa, Phascolarctos cinereus
QNPVTFRDVAVDFSLEEWKCLSPAQRALYRDVMLENYENLASVGPRLPFSKPYVISQLERGEAPWMPEEEVPRDHWPDLFN

SEQ ID NO: 897 - protein, 81 aa, Phascolarctos cinereus
SQIPLTFQDVAVDFTWEEWGLLEPSQKDMYWDVMLENYENFVSLGGLPICLPDVISRMERIEAPWMAEGGVLVSTFLGSLS

SEQ ID NO: 898 - protein, 81 aa, Myotis lucifugus
LQESVTFKDVAVLFTQDEWAQLSPAQRALYRDVMLENYSHLVSLGLLGPKPDLFAQLGKGEEWTPEDTSRGFCLDWMTIPV

SEQ ID NO: 899 - protein, 81 aa, Puma concolor
EELPVVFEDVAVYFTREEWGMLVKRQKELYRDVMRMNYELLASLGPAAAKPDLILKLERRAAPWIKDPNGPKWGKGRPPGK

SEQ ID NO: 900 - protein, 81 aa, Ailuropoda melanoleuca
EELPVVFEDVAVYFTREEWGMLVKRQKELYRDVMRMNYELLAALGPAAAKPDLISKLERRAAPWIKDPNRPKWGKGRPLGK

SEQ ID NO: 901 - protein, 81 aa, Ailuropoda melanoleuca
MTFEDVAVEFTQWEWGQLDPAQQDLYREVMLENFKNLASLGLPVSKPYVITQLEEGKDPCVLDGEISTEYLSPPPDWEKRP

SEQ ID NO: 902 - protein, 81 aa, Phyllostomus discolor
IGSDLFRDVAVVFSREEWEQLTPAQRDLYRDVMLEIYSILLSLGPDLAVSKPDVISFLEQGKEPWRVEEAVTGGLCPVLES

SEQ ID NO: 903 - protein, 81 aa, Phascolarctos cinereus
ARGPVSFADVAVYFSPEEWGRLRPAQRALYRDVMRETYGHLGALGFPGPKPALMCWMDEETEVWGPDARDPEEAGEKGTEN

SEQ ID NO: 904 - protein, 81 aa, Phascolarctos cinereus
QDLVTFKDVSVDFTREEWMRLDHPQRALYRDVMLENYRNLVLVSLGHPISKPDVISRLEQGGVPWVLKKGATGRAFSDRET

SEQ ID NO: 905 - protein, 81 aa, Phascolarctos cinereus
PQESVTFKDVAVDFTWEEWGYLDTSQKELYWEVMLENYRNLVSLGLADSNVDMISQLESGEAQGIPVDSVLTSCWPDGDRR

SEQ ID NO: 906 - protein, 81 aa, Lynx canadensis
AQKSLTLEDVAVDFSREEWRLLAPAQKDLYRDVMLENYRNLVSVGHQASKPDVLAKLERGEEPWAIEEEVRSGTSPETGKV

SEQ ID NO: 907 - protein, 81 aa, Phyllostomus discolor
SPTLVTFKDIHVNFTREEWNLLDAAQQIMYKDVMLENYKNLVSVGHQLPKPDVILQLEKGEEPWLVERGVRQDTRPDWDTA

SEQ ID NO: 908 - protein, 81 aa, Phyllostomus discolor
YKESVMFRDVAVDFSQEEWECLDPAQRDLYRDVMLENYSNLLSMGLYIPKPQVISLLEQGKEPWMVGRELTRGLCSDLESM

SEQ ID NO: 909 - protein, 81 aa, Canis lupus
SLESDLFRDVAVVFSQEEWEQLVPTQRDLYRDVMLETYNNLVSLGLAISKPDVISFLEQGKEPWMVEKAATGGLCPVLESR

SEQ ID NO: 910 - protein, 81 aa, Lynx canadensis
LQGLLTFRDVAIEFSQDEWGCLNQSQRELYRDVMLETYGHLLFLGLIVSKPHLVIFLEQKRELWDVKRKKTVRTQKGENTS

SEQ ID NO: 911 - protein, 81 aa, Bos mutus
LQVSVSFEDVTVDFSREEWQHLDSAQRRLYQDVMLENYSHLLSLGYEVPKPEVIFKLEQGEEPWALKEKTLHHSCSDDTTL

SEQ ID NO: 912 - protein, 81 aa, Canis lupus
RPGAVSFADVAVYFSPEEWGCLRPAQRALYRDVMRETYGHLGALGFADAKPVLIAWLERKAEVWTPEAEDPEEGARHPGSG

SEQ ID NO: 913 - protein, 81 aa, Muntiacus muntjak
LQDLVTFKDVTVEFNQEEWALLDSSQQKLYRDVMLENYGNLASLGYHVDKPSLISQLEQEDKVMTEEGGILPGTCPDLETV

SEQ ID NO: 914 - protein, 81 aa, Muntiacus muntjak
QAGSDLFRDVAVVFSQEEWEQLAPTQRDLYRDVMLETYSNLVSLGLAVSKPDVISFLEQGKEPWTVEGVATGGLCPVLKSR

SEQ ID NO: 915 - protein, 81 aa, Ailuropoda melanoleuca
QGLVSFKDVAVDFTQEEWQQLDPAQRTLYRDVMLENFSHLVSIGYAVSKPDVISKLEQGEDPWIIKRDIPNWIYPDENQAD

SEQ ID NO: 916 - protein, 81 aa, Lynx canadensis
SQGLVSFKDVAVDFTQEEWQQLDPAQRTLYRDVMLENFSHVISLGYPVSKPDVISKLEQGEDPWIIKRDVSNWIYTDENQA

SEQ ID NO: 917 - protein, 81 aa, Lynx canadensis
AQGLVTFRDVAIEFSQEEWKCLEPAQRNLYRDVTLENFSNLVSLGLSISKPDLISLLEQGREPWMIANDMTGPWCPELESR

SEQ ID NO: 918 - protein, 81 aa, Lynx canadensis
GKPGALSFADVAVYFSSEEWGCLRPAQRALYRDVMRETYGHLGALGEARPPALISWMERKKEAWSPEAEDPEDRARHPGYG

SEQ ID NO: 919 - protein, 81 aa, Bos indicus
VQGSVSFEDVAVGFSQEEWQILGPSQKALYWDVMLENYCNLVSVGYQAPTPNSLFQLEQGGPPWTVEGAALSPTCSGKKLY

SEQ ID NO: 920 - protein, 81 aa, Muntiacus muntjak
RKRGSLTLEDVAVDFTWEEWQLLAPAQKALYRDVMLENYGNLVFVGYQASKPAALSRLERGEPWPVEDEVHSQLCPEMRKD

SEQ ID NO: 921 - protein, 81 aa, Desmodus rotundus
SVAFRDVIVDFTQEEWQQLKPAQKDLYRDVMMENYWNLVSLDLETRPDKKESDPQEDDWEDRPSIAVVAEGPMRTGDQGCI

SEQ ID NO: 922 - protein, 81 aa, Muntiacus muntjak
QPDLVTFGDVAVDFSQEEWEWLNPAQRSLYRTVMLDNYRSLVSLGVSASKPDVISLLEQGKEPWLVKEEGPRGARPDSSPT

SEQ ID NO: 923 - protein, 81 aa, Ailuropoda melanoleuca
QEPVTFEDVAVYFTQNQWAKLDPTQRALYREVMLENYANVASLVAFPFPKPDLVSQLERGEVPWGPDPWEAEVLRGICPGG

SEQ ID NO: 924 - protein, 81 aa, Lynx canadensis
GPWTLLTFRDVAIEFSQEEWGCLNHSQRELYRDVMLETYGHLLFLGLVSKPDLVILLEQKKELWGVKRKETVGCQFEGHVT

SEQ ID NO: 925 - protein, 81 aa, Desmodus rotundus
SVTFRDVIVDFTQEEWEQLKPVQKDLYRDVMMENYWNLVSLDLETEGDMNDPDPEKDSWEDRPSVTSSMPAPPRLEGPRGA

SEQ ID NO: 926 - protein, 81 aa, Macaca fascicularis
IWDLVMFRDVAVDFSQEEWECLNSYQRNLYRDVILENYSNLVSLGCSISKPDVITLLEQGKEPWMVMRDEKRRWTLDLESR

SEQ ID NO: 927 - protein, 81 aa, Phascolarctos cinereus
SQESVTFQDVAVDFTREEWKRLDSAQRDLYRDVMLENYQNLVSLGLLVFQSDVISQLENGEVPLVPGGEVPRGTRPGSVNQ

SEQ ID NO: 928 - protein, 81 aa, Phyllostomus discolor
MMGLVTFEDVAVDFTQEEWQYLNPPQRILYRGVMMETYRNLVFVAGQQATKPDLILKMEVEEPYLAEDKIPIWSCPEEACQ

SEQ ID NO: 929 - protein, 81 aa, Ailuropoda melanoleuca
LQESVTFRDVAVFFSQDEWLRLDSAQRTLYREVMLENYGTLVSLGIPFSTPKVICQLQQGEDPCVVDRELPQDAWPGLKTQ

SEQ ID NO: 930 - protein, 81 aa, Ailuropoda melanoleuca
KQGGVTFEDVAVYFSQEEWSLLNEAQRRLYHDVMLENFALISSLGCCCRAEAVETPFEQSISVGVSQAKTPKEPRSSQKTH

SEQ ID NO: 931 - protein, 81 aa, Lynx canadensis
SQGSVTFRDVAIDFSQEEWEWLQPTQRDLYRHVMLENYSHLVSLGLNISKPYVVSLLEQGKEPWLEKRGVRRNLFSEPNRE

SEQ ID NO: 932 - protein, 81 aa, Lynx canadensis
KPGAVSFADVAVYFSPEEWGCLRPAQRALYRDVMRETYGHLGALGFRGTKPALISWVEEEADLWGPDARDPEVGECLTAAD

SEQ ID NO: 933 - protein, 81 aa, Muntiacus muntjak
GLLSFEDVALYFTREEWDTLDWAQKALYRDVMLDNYRHIVSLGFPFPKPEVICQLEQWEEPWILDLPRAGTRKASGSACPD

SEQ ID NO: 934 - protein, 81 aa, Ailuropoda melanoleuca
TVGSVMFSDVSVDFSQEEWECLDPGQRDLYRDVMLENYSNLLSMGLYIPKPQVISLLEQGKEPWMVGRELTRGLCSDLESM

SEQ ID NO: 935 - protein, 81 aa, Lynx canadensis
SKVPVTFGDLAIYFSQEEWEWLSPIQKDLYEDVMLENYQNLVSLGLSFRRPNVITLLEKGRAPWMVEPVRKRRGLDSRSKY

SEQ ID NO: 936 - protein, 81 aa, Gorilla sp.
KPGAVSFADVAVYFSREEWGCLRPAQRALYRDVMRETYGHLGALGVGGSKPALISWVEEKAELWDPAAQDPEVAKCPTEAD

SEQ ID NO: 937 - protein, 81 aa, Ailuropoda melanoleuca
PQKSVTFEDVAVYFTQTEWDGLSPAQRALYRDVMLENYGNVASLGFSLLKPAVISQLEGADELEGPSPLVAGTEIGPQGLW

SEQ ID NO: 938 - protein, 81 aa, Gorilla sp.
RQEPVTFEDVAVYFTQNEWASLDSVQRALYREVMLENYANVASLAFPFITPVLVSQLEQGELPWGLDPWEPMGREALRGIC

SEQ ID NO: 939 - protein, 81 aa, Acinonyx jubatus
LQGSLSFEDVTVGFSQEEWQRLDPAQRTLYRDVMLENYSHLVAVGCCVPKPDVIFRLEQGQQPWLVEEESLDQSCPEVCRV

SEQ ID NO: 940 - protein, 81 aa, Macaca mulatta
KEKLVTFEDVAVYFTQAEWDGLSPAQRTLYRDVMLENYGNVASLGFPLLKPAVISQLEGGGELGGPSPLAAGTGLWGLRTG

SEQ ID NO: 941 - protein, 81 aa, Odocoileus virginianus
PQESVTFEDVAVNFSYEEWQCLTHAQRHLYTDVMLENYGNMVSLGFSFSKPPLISRLEQGTEPYVQDRQDWEFLNCSYPAA

SEQ ID NO: 942 - protein, 81 aa, Odocoileus virginianus
VTELLTFKDISVDFTQEEWGQLAPAHRNLYREVMLENYGNLVSVAGCQLSKPSVISQLEKGEEPWMTEKEGAGDPSSDLKS

SEQ ID NO: 943 - protein, 81 aa, Sapajus apella
FQESVAFEDVAVYFTQNQWGSLDPAQRALYSEVMLENYANVASLVAFPFPKPALISHLEKGEAPWGPDPWDAEIPSGINQG

SEQ ID NO: 944 - protein, 81 aa, Acinonyx jubatus
YTLESLTLEDVAVDFTQEEWRLLAPAQKDLYWDVMLENFRNLVSVGYVASMPAALSRLERGGQWMTEDETRHWICPEIKKD

SEQ ID NO: 945 - protein, 81 aa, Rhinopithecus roxellana
SLESELFRDVAIVFSQEEWQCLAPAQRDLYRDVMLETYSNLVSLGLAISKPDVISFLEQGKEPWMVERVVSGGLCPVLKYR

SEQ ID NO: 946 - protein, 81 aa, Rhinopithecus roxellana
FQEAVTFKDVAVAFTEEELGLLDPAQRKLYRDVMLENFRNLVSVGHQSFKPDMISQLEREEKLWMKEFQTQRGKHSGDRNL

SEQ ID NO: 947 - protein, 81 aa, Cebus imitator
PQESVAFDDVAVYFTKKEWAIMVPDQRALYRDVMLENYEAVAFVAVPPTSKPALVSHLEQGKEPCFTQPQGVLSRRDWRAG

SEQ ID NO: 948 - protein, 81 aa, Callithrix jacchus
PQVSLTFEDVAVLFTRDEWRKLAPSQRNLYRDVMLENYRNLVSLGLPFTKPKVISLLQQGEDPWKVEKDCFGGSFLGCKSN

SEQ ID NO: 949 - protein, 81 aa, Rhinopithecus roxellana
SCEGSVSFRDVAINFSREEWQHLDPSQRNLYRDVMLETYSHLLSVGYQVPEAEVVMLEQGKEPWALQGERPRQSCPGEKLW

SEQ ID NO: 950 - protein, 81 aa, Cebus imitator
SYEGSVSFRDVAIDFSREEWRHLDLSQRNLYRDVMLETYSHLLSVGYQVPEAEVVMLEQGNEPWALQGERPHQSCPGEKLW

SEQ ID NO: 951 - protein, 81 aa, Cebus imitator
GPLTFRDVTIEFSHEEWKCLDPAQKALYKDVMLENYRNLVFLGITPKCTTKELPPIGNNNTGEKFRTVTLERHECYDIEDI

SEQ ID NO: 952 - protein, 81 aa, Callithrix jacchus
EMEPLTFRDVAIEFSLEEWQCLNPAQQDLFRNVMLENYRNLVFLGIAASKPDLITCLEKAKEPWKMKQHEMVDEPPGASTF

SEQ ID NO: 953 - protein, 81 aa, Macaca mulatta
SVAFEDVAVNFTQEEWSLLDPSQKNLYREVMQETLRNLASIGKKWKDQNIENEYKNPRSNQRGLMEERLFESEGHQPGEIL

SEQ ID NO: 954 - protein, 81 aa, Cebus imitator
SKAPITFGDLAIYFSQEEWEWLSPIQKDLYEDVMLENYRNLVSLGLSFRRPNVITLLEKGKAPWMVEPARRRRGPELTEAS

SEQ ID NO: 955 - protein, 81 aa, Bos taurus
MKLGSVTFEDVAVYFSWEEWALLDEAQRCLYHDVMLENFALTSSLVVSSSSHTIAQLGLGEESFVLPRMHMIPLSTRWAQR

SEQ ID NO: 956 - protein, 81 aa, Rhinopithecus roxellana
PQESVAFEDVAVYFTTKEWAIMMPAERALYRDVMLENYEAVAFVVPPTSKPALVSHLEQGKESCFIQPQGVLSRSDWRAGL

SEQ ID NO: 957 - protein, 81 aa, Callithrix jacchus
SQGSVTFRDVAIDFSQEEWKWLQPAQRDLYRCVMLENYGHLVSLGLSISKPDVVSLLEQGKEPWLGKRDVKRDLFPALSPQ

SEQ ID NO: 958 - protein, 81 aa, Callorhinus ursinus
QQRPVSFKDVVVGFTQEEWHRLNPAQRALYRDVMLETYSNLVSVGYEGTKPYVILKLEQEEAPWICEAACSGCHCQENICQ

SEQ ID NO: 959 - protein, 81 aa, Acinonyx jubatus
LQVSVSFEDVTVNFSREEWQRLDPAQRRLYRDVTLENYSHLRSVGYQVPKPEVIFKLEQGEGPWTLEGETPHQSCSGEDIG

SEQ ID NO: 960 - protein, 81 aa, Acinonyx jubatus
NSQGLLTFRDVAIEFSQEELRCLNHSQWELYRDVMFENYGHLLFLGLVVSKPDLVIFLEQKKDVWAVKRKETVATHPGRWE

SEQ ID NO: 961 - protein, 81 aa, Sapajus apella
AQKVLTFRDVAIEFSLEEWKFLDPAQQNLYRDVMLENYRNLFSIGLTVSKPGLITCLEQRKAPWNLKRREAVDGHPAMSSH

SEQ ID NO: 962 - protein, 81 aa, Sapajus apella
MAHLMFRDVAIDFSQEEWEGLDLKQRDLYRDVMLENYSNMVSLGLCIYQPDVFSLLEKGKEPWKILRDETRGPCPDMQSRC

SEQ ID NO: 963 - protein, 81 aa, Acinonyx jubatus
KPGALSFADVAVYFSSEEWGCLRPAQRALYRDVMRETYGHLGALGFAGPKPALISWMERKKEAWSPEAEDPEDRARHPGYG

SEQ ID NO: 964 - protein, 81 aa, Rhinopithecus roxellana
MAFEDVAVYFSQEEWGLLDTAQRALYRRVMLDNFALVASLGLSTSRPRVVIQLERGEEPWVPSGTDTVLSRNTYRRRNPGS

SEQ ID NO: 965 - protein, 81 aa, Bison bison
FQGSVTFRDVSIDFSQEEWEWLQPAQRDLYRHVMLENYGHLVSLGLNMSKPDVVSLLEQGKEPWLGNGDVSRELFPASKSN

SEQ ID NO: 966 - protein, 81 aa, Cebus imitator
VQEPVTFKDVAVDFTQEEWGQLDLVQRTLYRDVMLETYGHLLSVGNQIAKPEVISLLEQGEEPWSVEQTCPQRACPEWMRN

SEQ ID NO: 967 - protein, 81 aa, Ovis aries
PQEPVTFADVAVLFTPEEWLFLDSSQKSLYRDVMLENYRNVASVGDQLCKTRMSSHLEQREELCVTERGIFPGAHLGPHLQ

SEQ ID NO: 968 - protein, 81 aa, Callithrix jacchus
PLGSELFRDVAIVFSQEEWQWLAPAQRDLYRDVMLETYSNLVSLGLAISKPDVISFLEQGKEPWMVERVVAGGLCPVLESR

SEQ ID NO: 969 - protein, 81 aa, Ovis aries
AHMSLSFRDVAIDLSQEEWECLDPVQRALYRDVMLENYSNLVSLGCSTPKPDMITLLEQEKEPWMIMREGTGSWFTGLESK

SEQ ID NO: 970 - protein, 81 aa, Ovis aries
AQVSVTFDDVAVTFTQEEWGHLEPAQRTLYQEVMLETCRLLMSLGCPVPRPELIYQLEHGQELWTVKRDLSRSTCPGYSSE

SEQ ID NO: 971 - protein, 81 aa, Vulpes vulpes
SQELVAFEDVLVDFTPEEWQYLNSSQKTLYREVMLETYSNLVSVAGQQDTKPDLILKLELEGPCLAERKISVWSFPEEACQ

SEQ ID NO: 972 - protein, 81 aa, Acinonyx jubatus
KPGALSFADVAVYFSSEEWGCLRPAQRALYRDVMRETYGHLGALGCAGPKPALISWLERNTDDWEPAALDPQECPRGVAVQ

SEQ ID NO: 973 - protein, 81 aa, Bison bison
LQGGVTFEDVAVDFTQEEWQRLSPEQRDLYRDVTLENYRNLVSMGEQDSTKPEVILRLENGEEPWMVGTQELRSCSPAGKD

SEQ ID NO: 974 - protein, 81 aa, Callithrix jacchus
PQESVAFDDVAVYFTKKEWAIMVPDQRALYRDVMLENYEAVAFVAVPPTSKPALISHLEQGKEPCFTQPQGVLSRRDWRAG

SEQ ID NO: 975 - protein, 81 aa, Ovis aries
AKAPVTFGDLAIYFSQEEWEWLSPIQKDLYEDVMLENYQNLVSLGLSFRRPNVISLLEKGKAPWMVDPVKRRRGLDLGSKC

SEQ ID NO: 976 - protein, 81 aa, Vulpes vulpes
CEGSVSFEDVTMDFSREEWQQLDPAQRCLYQDVMLEIYSHLLFVGYNIPNPEIISRMEKGEEPWMREVQLPHQRHRERAFG

SEQ ID NO: 977 - protein, 81 aa, Ovis aries
MAFRDVAVDFTQDEWVLLSPAQRSLYREVMLENYSNLVSLGIPFSKPKLITQLEQGKESWREERKCSPVSCLGEWGHWVVQ

SEQ ID NO: 978 - protein, 81 aa, Vulpes vulpes
FQHLVMFRDVAVDFSQEEWECLNSYQRNLYRDVILENYSNLVSVAGCSISKPDVITLLEQGKEPWMVVRDERRRSLDLESR

SEQ ID NO: 979 - protein, 81 aa, Vulpes vulpes
SQSLVTFGDVAINFSQEEWEWLNSAQRNLYRSVMLENYRNLVSLGLCVSKPDMISSLEQRKEPWMVKRKLTRGRCPDLKAV

SEQ ID NO: 980 - protein, 81 aa, Acinonyx jubatus
ASVVFEDVAVNFTPEEWALLNPGQRKLYRDVMLETCRNLSAVGCRSQGNTSTPRPQWSILLNEPPGEDKTGIFTRKDSCSV

SEQ ID NO: 981 - protein, 81 aa, Acinonyx jubatus
RPRAVKFADVAVYFSTEEWGCLRPAQRALYRDVMQETYGHLGALGCAGPKPALISWLERNTDDWEPAALDPQECPRGVAVQ

SEQ ID NO: 982 - protein, 81 aa, Rhinopithecus roxellana
MAFEDVAVYFSQEEWGLLDTAQRALYRHVMLDNFTLVTSLGLSTSRPHVVIQLERGEEPWVPSGKDMTLARNTYRRLNAGE

SEQ ID NO: 983 - protein, 81 aa, Rhinopithecus roxellana
MVTFEDVAVHFTKTEWTGLSPAQRALYRSVMLENFGNLTALGYPVPKPALISLLEGGDMAWGLEAQDDPLAERTKNICKGV

SEQ ID NO: 984 - protein, 81 aa, Acinonyx jubatus
AQAPLSFEDVAVSFSREEWRLLVPAQKDLYRDVMLENYRNLVSVGYQASEPDSLFQLEHGGPLWVVEGAAPRPPCPEEIWE

SEQ ID NO: 985 - protein, 81 aa, Odocoileus virginianus
SLGSDLFRDVAIVFSQEEWEQLAPTQRDLYRDVMLETYSNLVSLGLAVSKPDVISFLEQGKEPWTVEEVAAGGLCPVLKSR

SEQ ID NO: 986 - protein, 81 aa, Callithrix jacchus
AAGRVTFEDVTVSFTKGEWQQLNPEQRELYRDVMLENYGNLVSVGLEETSKPSVILRLEEGKEPWSEEEVLRGGRPEKNWD

SEQ ID NO: 987 - protein, 81 aa, Callithrix jacchus
PQESVAFDDVAVYFTKKEWAIMVPDQRALYRDVMLENYEAVAFVVPPTSKPALISHLEQGKEPCFTQPQGVLSRRDWRAGF

SEQ ID NO: 988 - protein, 81 aa, Ovis aries
SQVSVTFEDVAVLFTRDEWRKLAPPQRNLYQDVMLENYSNLVSLGLLFPKPKVISLLQQGEDPWKVEKENLGGSSLGWKNS

SEQ ID NO: 989 - protein, 81 aa, Ovis aries
YRGPVTFKDITVEFTREEWKLLDTAQRTLYREVMQENYSHLISVGYCANRPNAIFKLKQGKEPWILEVQFPRQKNPEDLCN

SEQ ID NO: 990 - protein, 81 aa, Callithrix jacchus
RPRALKFVDVAVYFSSEEWGCLRPAQRALYRDVMRETYGHLGALGFPGPKPALISWMEQESEAWSSAAQDPENGESLGGAR

SEQ ID NO: 991 - protein, 81 aa, Callithrix jacchus
VNDLVTFKDVAIDFSQEEWQWMNPAQKRLYRSMMLENYQSLVSLGLCVSKPYVISLLEQGREPWEMTSEMRRSPFSDWESI

SEQ ID NO: 992 - protein, 81 aa, Cebus imitator
KPGAVSFADVAVYFSPEEWGCLRPAQRSLYRDVMRETYGHLGALGFPGPKPALISWMEQESEAWSSAAQDPEKGESLGGAQ

SEQ ID NO: 993 - protein, 81 aa, Tursiops truncatus
PQKSVTFEDVAVYFTQTEWDGLSPAQRALYRDVMLENYGNVASLGFPLLKPTVISQLEGGGELEGPSPLASGTGTGPQGLW

SEQ ID NO: 994 - protein, 81 aa, Acinonyx jubatus
TPDVVTFEDVAVCFSSGEWQCLTRAQRHLYTDVMLENYGNMLSAGLACPKPPLISHLEQGAVPCAEDLQDWGFLTCSFPVS

SEQ ID NO: 995 - protein, 81 aa, Neophocaena asiaeorientalis
QAEVTFEDVAVLLSREEWGRLGPVQKGLYRDVMLETYRNLVSLGGGPAGPKPEVITQLERGDEPWVPDVQGRERLTIDGSA

SEQ ID NO: 996 - protein, 81 aa, Pongo sp.
SKAPVTFGDLAIYFSQEEWEWLSPIQKDLYEDVMLENYRNLVSLGLSFRRPNVITLLEKGKAPWMVEPVRRRRAPDSGSKC

SEQ ID NO: 997 - protein, 81 aa, Leptonychotes weddellii
PQKSVTFEDVAVYFTQTEWDGLSPAQRALYRDVMLENYGNVASLGFSLLKPAVISQLEGAGELGGPSPLVDGTETGPQGLW

SEQ ID NO: 998 - protein, 81 aa, Pan troglodytes
MAFEDVAVYFSQEEWGLLDTAQRALYRRVMLDNFALVASLGLSTSRPRVVIQLERGEEPWVPSGKDMTLARNTYGRLNSGS

SEQ ID NO: 999 - protein, 81 aa, Rhinopithecus roxellana
LKGLVTFEDVAVEFTQEEWALLDPAQRTLYRDVMLENFRNLASLGNQVDKPGLISQLEQEDKVMTEERGIFPGACPDVENP

SEQ ID NO: 1000 - protein, 81 aa, Odocoileus virginianus
FQEPVTFEDVAVYFTQNQWASLDSAQRALYREVMLENYANVASLVSPFPRPDLISQLERGEAPWDPNPWEAEDLRGICPGE

SEQ ID NO: 1001 - protein, 81 aa, Rhinopithecus roxellana
YQTPVSFKDVVVGFTQEEWHRLSPAQRALYRDVMLETYSNLVSVGYEGTKPDVILRLEQEEAPWIGGAARPGCHCWEDIWQ

SEQ ID NO: 1002 - protein, 81 aa, Bison bison
PLKLVTFEDVAVDFTQEEWSLLDKSQKNLFRNVMMETIHHLVSVGYQISKSDVISQLEQGKELWSKAAGGFQGQRPGEHQG

SEQ ID NO: 1003 - protein, 81 aa, Balaenoptera acutorostrata
QAEVTFEDVAVLLSREEWGRLGPVQKGLYRDVMLETYRNLVSLGAGPTGPKPEVITQLERGDEPWVLDVQGREGPTIDGSA

SEQ ID NO: 1004 - protein, 81 aa, Cebus imitator
SQGLVTFGDVAIDFSQEEWEWLSPIQRNLYRKVMLENYRNLASLGLCVSKPDVISLLEQGKEPWTVKRRMTRARCPDTQHL

SEQ ID NO: 1005 - protein, 81 aa, Callithrix jacchus
FQEAVTFKDVAVAFTEEELGLLDSAQRKLYRDVMLENFRNLVSVGRQSFKPDMISQLEREEKLWMKEFQTQRGRHSGDRNQ

SEQ ID NO: 1006 - protein, 81 aa, Callithrix jacchus
IQGLLTFGDVAVAFTRIEWRHLDAAQRALYRDVMLENYGNLVSVGLLSSKPKLIAQLEQGAEPWMEVREAPSGTRAVPDYW

SEQ ID NO: 1007 - protein, 81 aa, Callithrix jacchus
FQELVTFRDVAIDFSGQEWEYLDPHQRDLYRDVMLENYRNLVSLGHSISKPVLVDLLEQGKEPWMILREETQFPGKEDRGH

SEQ ID NO: 1008 - protein, 81 aa, Callorhinus ursinus
PQEPVTFEDVAVYFTQNQWASLDPMQRALYREVMLENYASVASLAFPFPKPDLVSQLERGEAPWSPDPWEAEVLKGTCPGG

SEQ ID NO: 1009 - protein, 81 aa, Callorhinus ursinus
IQEPVTFKDVAVDFTQEEWGRLDPVQRTLYRDVMLETYRHLLSVGNQIAKPEVISLLEQGEEPWSVEQAYPQSTCPAVDTE

SEQ ID NO: 1010 - protein, 81 aa, Cebus imitator
EPGAVSFGDVAVYFSREEWGCLRPAQRALYRDVMRETYSHLGALGVGGSKPALISWMEEEAELWVPAAQDPEVAKCPTEAD

SEQ ID NO: 1011 - protein, 81 aa, Cebus imitator
ESVAFEDVAVYFTQNQWGSLDPAQRALYREVMLENYANVASLVAFPFPKPALISHLEKGEAPWGPDPWDAEIPSGISQGGE

SEQ ID NO: 1012 - protein, 81 aa, Delphinapterus leucas
QAEVTFEDVAVLLSREEWGRLGPVQKGLYRDVMLETYRNLVSLGAGPAGPKPEVITQLERGDEPWVPDVQGRERPNIDGSA

SEQ ID NO: 1013 - protein, 81 aa, Pan troglodytes
SLGSVTFTDVAIDFSQDEWEWLNLAQRSLYKKVMLENYRNLVSVGLCISKPVVISLLEQEKDPWVIKGGMNRGLCPDLECV

SEQ ID NO: 1014 - protein, 81 aa, Sapajus apella
MAFEDVAVYFSQEEWGLLDTAQRALYRRVMLDNFALVASLGLSTSRPRVVIQLERGEEPWVPSGTDMTMSRNTHRRRNSGF

SEQ ID NO: 1015 - protein, 81 aa, Callorhinus ursinus
FQDSVTFEDVAVRFSSGEWQCLTRAQRHLYADVMLENYWNVISVGFAVPKPPLISHLEQGAEPCVQDLQDGGFLSCSFPVS

SEQ ID NO: 1016 - protein, 81 aa, Cebus imitator
SQGHVTFEDIAVYFSQEEWGLLDEAQRCLYHDVMLENFSLMTSVAGLSQNNHKDSCLQWKVPVSMNNVAQCSPDEVHYTPM

SEQ ID NO: 1017 - protein, 81 aa, Cebus imitator
ARDLVMFRDVAVDFSQEEWECLNSYQRNLYRDVILENYSNLVSLGCSISKPDVITLLEQGKEPWLVVRDEKRRWSLGPTFK

SEQ ID NO: 1018 - protein, 81 aa, Macaca mulatta
PQGLVTFGDVAVDFSQEEWEWLNPNQRTLYRKVMLENYKNLASLGLCVSKPDVISSLEQGKEPWTVKRKMTRAWCPDLKIV

SEQ ID NO: 1019 - protein, 81 aa, Bos taurus
SQGRLTFQDVAIDFTQEEWECLDLGQRELYRDVMLENYGNLASLGLVISKPDLVTFLEQMKDPWDTRRMETPAVHPAVSSH

SEQ ID NO: 1020 - protein, 81 aa, Ovis aries
PRESVTFEDVAVNFSHEEWQCLTHSQRHLYKDVMLENYGNMVSLGFSFSKPPLISCLEQGAESYVQDQQDWEFLSCSYPVS

SEQ ID NO: 1021 - protein, 81 aa, Ovis aries
QAEVTFEDVAVFLSQEEWGLLGPAQKGLYREVMLETYRNLVSLGAGLAGPKPEVIVHLERGDELWVLDMRGAEQPSVDGSA

SEQ ID NO: 1022 - protein, 81 aa, Otolemur garnettii
KELPSVFEDVAVYFTREEWGMLDKRQKELYRDVMRMNYELLASLGPAAAKPDLISKLERRAAPWIKDPNGPKWGEGHPPGK

SEQ ID NO: 1023 - protein, 81 aa, Otolemur garnettii
MAFEDVAVYFSQEEWGLLDTAQRALYRHVMLENFTLVSSLGLSTSRPRVVVQLERGEEPWVPSRIDSTPARNAQGRRNPGS

SEQ ID NO: 1024 - protein, 81 aa, Macaca mulatta
SHELLTFKDISVDFTQEEWGQLAPAYQNLYREVMLENYSNLVSVAGYQLSKPSVISQLEKGEEPWMAEKEGPGDPSSDLKS

SEQ ID NO: 1025 - protein, 81 aa, Ovis aries
TSQSPLTFGDVAVEFSGEEWAWLDSAQRSLHRSVMLENYRNLASLGKVSKPEMISSLEQRKEPWAVTRKTTGGECADSQTL

SEQ ID NO: 1026 - protein, 81 aa, Otolemur garnettii
SQGLVTFGDVAVDFSQEEWAWLSTTQRTLYRKVTLENYRNLASLGLCVSKPAVISLLEQGKEPWIVKRKMTRGGCPDLNAV

SEQ ID NO: 1027 - protein, 81 aa, Callithrix jacchus
AQESMTFRDVAVFFSQDEWLHLDSAQRALYREVMLENYSTLVSLGIPFSMPKVIHQLQQGQDPCTVEGDVPSNTCLGFKTW

SEQ ID NO: 1028 - protein, 81 aa, Vulpes vulpes
CWGLLSFKDISMEFTWEEWQLLDSAQKYLYRDVILENYSHLVSLGYHGTKPDLIFKLEQGEEPWMINARVSRQSYPEGWKE

SEQ ID NO: 1029 - protein, 81 aa, Ovis aries
HQEVVTFEDVAVYFTQTEWAGLSPAQRALYRSVMLEIYGNLTSLGYPVPKPELVSLLERGDLPVGLETQDNPPAQGTRDIY

SEQ ID NO: 1030 - protein, 81 aa, Enhydra lutris
FEELVTFEDVAVYFSENEWTSLAPTQRVLYRDVMLENYGAVASLAAFPFPKPALISQLERGEAPWCKAPQGALDGEGPRGI

SEQ ID NO: 1031 - protein, 81 aa, Bos taurus
FQEPVTFEDVAVYFTQNQWASLDSAQRALYREVMLENYANVASLVSPFPRPDLISQLERGEAPWDPDPWEAEDLRGICPGG

SEQ ID NO: 1032 - protein, 81 aa, Enhydra lutris
FQEAVTFKDVAVVFSEEELGLLDSTQRKLYRDVMLENFRNLVSVGHSSSKPDMISQLEREEEKLYVKEICTERGRHSDKNC

SEQ ID NO: 1033 - protein, 81 aa, Zalophus californianus
AYGSLSFGEVAISFSQEEWECLDPAQRALYRDVMLETYSNLVSLAGSSISKPDVITLLEQEKEPWVVVRRETSRWYPDLES

SEQ ID NO: 1034 - protein, 81 aa, Delphinapterus leucas
PQVLVSFEEVAVLLSQEEWGHLGPAQKRLYRDVMLETYGNLVSLGLQGSKPDVISKLEQGEEPWAPHSPRIEGSWIWRRRR

SEQ ID NO: 1035 - protein, 81 aa, Ovis aries
PLTFEDVALYFSEEEWLIMDPNQRTLYLDVMQELYENVTSLGLKLKNDTGNDPPVSLPTLEIQPSGCEVVRKATMKDAETT

SEQ ID NO: 1036 - protein, 81 aa, Rhinopithecus bieti
AHALVTFRDVAIDFSQKEWECLDTTQRKLYRDVMLENYSNLVSLGYSGSKPDVITLLEQGKEPCVAVRDVTGTQYPGLLSR

SEQ ID NO: 1037 - protein, 81 aa, Ovis aries
PLESVTFEDVAVDFTQEEWSLLDKSQKNLFRNVMLETVTHLVSVGYQISKSDVIFQLEQGKELWPEAAGGLQGQSPDEVTP

SEQ ID NO: 1038 - protein, 81 aa, Macaca mulatta
ACESITFGDVAIDFSHQEWEYLNLVQKTLYQEVMMENYDNLVSLGHSISKPDLITLLEQGKEPWMIVGEETRGECTDLDSR

SEQ ID NO: 1039 - protein, 81 aa, Enhydra lutris
SQVSVTFEDVAVLFTRDEWRKLGPSQRNVYQEVMLENYSNLVSLGLLFSKPRVISLLQEGEDPWKVEKESPGGPSLGWNSS

SEQ ID NO: 1040 - protein, 81 aa, Bos taurus
VQGSVSFEDVAVGFSQEEWQILGPSQKALYWDVMLENYCNLVSVGYQAPTPNSLFQLEQGGPPWTVEGAALSSTCSGYQAT

SEQ ID NO: 1041 - protein, 81 aa, Ovis aries
LQGGVTFEDVAVDFTQEEWQQLSPEQRGLYRDVTLENYRNLASMGGEDFAKPEVILRLENGEEPWMVETQVLRSCGPAEKD

SEQ ID NO: 1042 - protein, 81 aa, Pongo sp.
ARGKSKSKAPVTFGDLAIYFSQEEWEWLSPIQKDLYEDVMLENYRNLVSLGLSFRRPNVITLLEKGKAPWMVEPVRRRRAP

SEQ ID NO: 1043 - protein, 81 aa, Ovis aries
QPQGTMTFKDVEVTFSQDEWGLLDASQRNLYRDVMLENYGNMASVVGPFTKPALISWLEAREPWGLNVQGVQLKGNPGAAP

SEQ ID NO: 1044 - protein, 81 aa, Otolemur garnettii
LQESVTFRDVAVLFSQDEWLHLDSAQRTLYREVMLENYNNLASLGIPFSMPKVICQLQQGEDPCTVEGEVPSDSCIDAKGQ

SEQ ID NO: 1045 - protein, 81 aa, Pongo sp.
FQEPVTFEDVAVYFTQNEWASLHPTQRALYRGVMLENYANVTSLSAFPFPKPDLIFQLEQGEAAWGPDPWTLDGGEALRGM

SEQ ID NO: 1046 - protein, 81 aa, Macaca mulatta
ASVTVTFDDVALYFSEQEWEILEKWQKQMYKQEMKTNYQTLDSLGYAFSKPDLITWMEQGRMLFISEQGCLDKTRRTTSPP

SEQ ID NO: 1047 - protein, 81 aa, Ovis aries
SQSPLTFGDVAVEFSGEEWAWLDSAQRSLHRSVMLENYRNLASLGLCLSKPEMISSLEQRKEPWAVKRKLTGGECPDSQTL

SEQ ID NO: 1048 - protein, 81 aa, Otolemur garnettii
QELLTFKDVSVEFSMDEWACLDPAQQTLYQDVMLENYRHLVFLGLTLSKPDLITCLEQSKEPWKVKSHQTVVKHPAVSDPP

SEQ ID NO: 1049 - protein, 81 aa, Otolemur garnettii
FQGLMTFEDVTVEFTQWEWGQLDPAQKDLYREVMLENFRNLASLGLPLSKPYVICQLEEGQEPCMLEKEISVGTQSVGEAT

SEQ ID NO: 1050 - protein, 81 aa, Vicugna pacos
FKEAVTFKDVAVTFTEEELGLLDPAQRELYRDVMLENFRNLVSVGHQCFIPDVISQLEREEKLWMLRTAAQSRCSSGDKNL

SEQ ID NO: 1051 - protein, 81 aa, Trichechus manatus
PPESVTFEDVAVYFTQKEWASLMPAQKALYRDVMLENYEAVAFLAPATSKPALISQLEQGVEPSFSQAQGDLSMRDRGAGL

SEQ ID NO: 1052 - protein, 81 aa, Ovis aries
PQKLVTFEDVAVYFTQTEWDGLSTAQRALYRDVMLENYGNVASLGFPLLKPAVISQLEGGGELEGPSSLASGAGTGPQGLW

SEQ ID NO: 1053 - protein, 81 aa, Odocoileus virginianus
SRSPLTFGDVAVEFSGEEWARLDSAQRSLHRSVMLENYRNLASLGLCMSKPEMISSLEQRKEPWAVKRKSTRGRCPDSQTA

SEQ ID NO: 1054 - protein, 81 aa, Callithrix jacchus
PQKSVTFEDVAVYFTQAEWDGLSPAQRTLYRDVMLENYGNVASLGFPLLKPAVISQLEGGGELGGPSPLAAGTGLHVLRTV

SEQ ID NO: 1055 - protein, 81 aa, Rhinopithecus roxellana
FQRSVLFSDVSIDFSPEEWEYLDLEQKDLYRDVMLENYSNLVSLGCFISKPDVISLLEQGKEPWKVVRKGRRQYPDLETKY

SEQ ID NO: 1056 - protein, 80 aa, Cebus imitator
MGEPLEFRDVAIEFSLEEWHCLDTAQRNLYRDVMLENYRNLVFLGIAVSKPDLITWLEQGKKPLTVKGHEMIATPPGRCK

SEQ ID NO: 1057 - protein, 81 aa, Cebus imitator
AQESVTFEDVAVNFTDREWQCLTYAQRHLYKDVMLENYGNMVSVGFPFPKPPLISHLERGVELCVQDPQDRESLSCSCLVS

SEQ ID NO: 1058 - protein, 81 aa, Acinonyx jubatus
FQHLVMFRDVAVDFSQEEWECLNSYQRNLYRDVILENYSNLVSVGCTISKPDVITLLEQGKEPWMVVRDERRRRSLDLEAR

SEQ ID NO: 1059 - protein, 81 aa, Rhinopithecus roxellana
MVSFEDVAVPLSQEEWNCLIPAQRGLYRDVMLETYGNLVSLGLQASKPDVISRLEQGDEPWTPHILRTQGSWSWRHKREGY

SEQ ID NO: 1060 - protein, 81 aa, Macaca mulatta
RPESVTFEDVAVYFSENEWIGLGPAQRALYRDVMLENYGAVASLAAFPFPKPALISQLERGEAPWCSVPWGALDGEDPRSI

SEQ ID NO: 1061 - protein, 81 aa, Callithrix jacchus
EPGPVTFGDVAVYFSREEWGCLRPAQRALYRDVMRETYSHLGALGVEGSKPALISWVEEEAELWGPAAQDPEVAKRPTEAD

SEQ ID NO: 1062 - protein, 81 aa, Acinonyx jubatus
SHGPLSFEDVAVAFTKEEWQQLDPAQRTLYRDVMLENFSHVISLGHPVSKPDVISKLEQGEEPWIIKRDVSDWIYPERETR

SEQ ID NO: 1063 - protein, 81 aa, Rhinopithecus roxellana
AQESVTFEDVAVNFTNREWQSLTYAQRHLYKHVMLENYRNMVSLGFPFPKPPLISHLERGVEPCVQDPQDKESLSCSYPVS

SEQ ID NO: 1064 - protein, 81 aa, Odocoileus virginianus
HQESLTFKDVAVNFTQEEWHHVDAAQRRLYKDVMLENYSHLVSLGYQVSKPEVIFKLEQGEEPWIAEGEIQRPVCPDWKTR

SEQ ID NO: 1065 - protein, 81 aa, Pan troglodytes
SQESVSFKDVTVGFTQEEWQHLDPSQRALYRDVMLENYSNLVSVGYCVHKPEVIFRLQQGEEPWKLEEEFPSQSFPEVWTA

SEQ ID NO: 1066 - protein, 81 aa, Cebus imitator
AQESVMFSDVSIDFSQEEWECLNDDQRDLYRDVMLENYSNLVSMAGHSISKPNVISYLEQGKEPWLVDREITSGQWPVLES

SEQ ID NO: 1067 - protein, 81 aa, Papio anubis
MAFEDVAVYFSQEEWGLLDTAQRALYRHVMLENFTLVTSLGLSTSRPYVVIQLERGEEPWVPSGKDMTLARNTYRRLNAGS

SEQ ID NO: 1068 - protein, 81 aa, Ursus maritimus
HQDLVTFKDVAVYFTQTEWAGLSPAQKALYRSVMLENYGNLTSLGYPVPKPALISLLEGGNLPWGLEAQDNPSAERTKDIC

SEQ ID NO: 1069 - protein, 81 aa, Cebus imitator
SLGSELFRDVAIVFSQEEWQWLAPAQRDLYRDVMLETYSNLVSLGLAISKPDVISFLEQGREPWMVERVVAGGLCPVLESR

SEQ ID NO: 1070 - protein, 81 aa, Cebus imitator
FQEPVTFEDVAVYFTQNEWTSLQPSQRALFREVMLENYATVTSLSAFPFPKPDLIFRLEQGEAAWGPDPWTLAGEEALRGL

SEQ ID NO: 1071 - protein, 81 aa, Macaca nemestrina
YQTPVSFKDVVVGFTQEEWHRLSPAQRALYRDVMLETYSNLLSVGYEGTKPDVILRLEQEEAPWIGEAACPGCHCWEDIWQ

SEQ ID NO: 1072 - protein, 81 aa, Physeter macrocephalus
DEALMAFKDVAVAFTQKEWKLLSPAQRTLYRDVMLENYSHMVSLGIAFPKPKLITQLEQGEEPWREESESLLDLCPAEPRT

SEQ ID NO: 1073 - protein, 81 aa, Delphinapterus leucas
QAQETLTFEDVAVDFTWEEWQLLAPPQKDLYRDVMLENYSNLLSVGFQASKPNVLSKLGQGEPWTMEDEIHCQTRSEIWKV

SEQ ID NO: 1074 - protein, 81 aa, Leptonychotes weddellii
PQEPVTFEDVAVYFTQNQWASLDPTQRALYREVMLENYASVASLVVFPFPKPDLVSQLEREEAPWGPDPWEAEVLRGICPG

SEQ ID NO: 1075 - protein, 81 aa, Leptonychotes weddellii
SQEPVTFEDVAVYFTQNQWASLDPMQRALYLEVMLENYANITSLAALPFPKPDLILQLEQGEAPWDLDPWTPLEGEALEGV

SEQ ID NO: 1076 - protein, 81 aa, Phascolarctos cinereus
SLESVTFQDVAVNFTQEEWGHLEPAQKDLYREVMLENYQNFVSLGLPFSKPHVISQLERGEAPWITERDVPRVSCQDFFIQ

SEQ ID NO: 1077 - protein, 81 aa, Pongo sp.
AQESVMFSDVSVDFSQEEWECLNDDQRDLYRDVMLENYSNLVSMGHSVSKPNVISYLEQGKEPWLVDRELTRGQWPVLESR

SEQ ID NO: 1078 - protein, 81 aa, Callorhinus ursinus
SYGSFSFEDVTVGFTQEEWQHLGPAQRILYRDVMLENYSHLVSVGCCIPKPEVILKLEQGEQPWILEEESPSQSYPGLPTD

SEQ ID NO: 1079 - protein, 81 aa, Callorhinus ursinus
AHHLVMFRDVAVDFSKEEWECLNSYQRNLYRDVILENYSNLVSVAGCSISKPDVITLLEQGKEPWMVVRDERRRRSLDLES

SEQ ID NO: 1080 - protein, 81 aa, Tursiops truncatus
HQEVVTFEDVAVYFTQTEWAGLSPAQRALYRSVMLEIYGNLTSLGYPVPKPALVSLLERGDLPWGLETRDDPPAQGTKDIC

SEQ ID NO: 1081 - protein, 81 aa, Phascolarctos cinereus
CQETLTFKDVAVDFTREEWGHLGPAQRDLYKEVMLDNYRNLVSLGLQVSKPDVIFQLERGESPSMLEGKDSSDPCPEFLSQ

SEQ ID NO: 1082 - protein, 81 aa, Ursus arctos
SKVPVTFGDLAIYFSQEEWEWLSPIQKDLYEDVMLENYQNLVSLGLSFRRPNVITLLEKGKAPWMVEPARKRRGVDSGSKC

SEQ ID NO: 1083 - protein, 81 aa, Leptonychotes weddellii
PQVLVSFEDVAVFLSREEWGCLGPAQRGLYSNVMLETYRNLISLGLQGSKPDVISRLEKGEEPWAPYSPKIEEGWIRSHRS

SEQ ID NO: 1084 - protein, 81 aa, Pan troglodytes
MAFEDVAVYFSQEEWGLLDTTQRALYRHVMLENFTLVTSLGLSTSRPHVVIQLERGEEPWVPSGTDTTLSRTTYRRRNPGS

SEQ ID NO: 1085 - protein, 81 aa, Enhydra lutris
QAEVTFEDVAVLFSREEWGRLGPAQRGLYRDVMLETYRNLVSLGAGPAGPKPGVITQLERGDEPWVLDAQGTEGKERLRVS

SEQ ID NO: 1086 - protein, 81 aa, Monodelphis domestica
AQVLVTFQDVAVDFTQEEWRLLDLGQKELYKEVMLENVQNMLFLGLPVPREDWISHFDQGRAPWMLEGEGPSNSRLDGQRR

SEQ ID NO: 1087 - protein, 81 aa, Saimiri boliviensis
FQEPVTFEDVVVYFTQNEWTSLQPSQRALYREVMLENYATVTSLSAFPFSKPDLIFRLEQGEAAWGSDPWTLAGEEAPRGL

SEQ ID NO: 1088 - protein, 81 aa, Balaenoptera acutorostrata
HQEVVTFEDVAVYFTQTEWAGLSPAQRALYRSVMLEIYGNLTSLGYPVPKPALVSLLERGDLPWGLETRDDRPAQGTKDIC

SEQ ID NO: 1089 - protein, 81 aa, Callorhinus ursinus
ARASLSFEDVAVGFSWEEWQLLAPSQKDLYRDVMLENYRNLVSVGYEASKPDSVFQLEQGEPPWMVEGAAQSQTCQEEIWE

SEQ ID NO: 1090 - protein, 81 aa, Delphinapterus leucas
KDQGSLTLEDVAVDFTWEEWQLLAPAQKDLYRDVMLENYSNLLSIGYQASKPDALSRLERGEPWPVEDEIHSQICPEMRKD

SEQ ID NO: 1091 - protein, 81 aa, Balaenoptera acutorostrata
PQASVSFKDVTVEFTQEEWWQMDSAQRTLYRDVMLENYSHLVSVGYCFTKPELIFMLEQGEDPWLLEKEFVNRSSPEESQP

SEQ ID NO: 1092 - protein, 81 aa, Ursus maritimus
ARASLSFEDVAVGFSWEEWQLLAPSQKDLYRDVMLENYRNLVSVGYQASKLDSLFQSEQGGPPWTVEGAAQSQTCPEEIWE

SEQ ID NO: 1093 - protein, 81 aa, Papio anubis
MVSFEDVAVLLSQEEWDCLIPAQRGLYRDVMLETYGNLVSLGLQASKPDVISRLEQGDEPWTPHILRTQRSWSWRHKRECY

SEQ ID NO: 1094 - protein, 81 aa, Callorhinus ursinus
LQKSVTFEDVAVYFTQTEWDGLSPAQRALYRDVMLENYGNVASLGFSLFKPAVISQLEGAGELGGPSPLVDGTETGPQGLW

SEQ ID NO: 1095 - protein, 81 aa, Rhinolophus ferrumequinum
SQSLVTFGDVAVDFSQEEWERLNSAQRGLYRDVMLENYRSLVSLGLCFSKPDMISSLEQRKEPWMPKRKLMRGQCPGWKAV

SEQ ID NO: 1096 - protein, 81 aa, Rhinopithecus roxellana
LKDLVTFKDVAIDFSQEEWQWMNPAQKHLYRSMMLENYQSLVSLGLCISKPYVISLLEQGREPWEMTSEMTRSPFSDWESI

SEQ ID NO: 1097 - protein, 81 aa, Callorhinus ursinus
SQSLVTFGDVAVDFSQEEWEWLNSAQRNLYRSVMLENYRNLVSLGLCVSKPDMISSLEQRKEPWMVKRKLTRGRCPDLKTV

SEQ ID NO: 1098 - protein, 81 aa, Delphinapterus leucas
HQEVVTFEDVAVYFTQTEWAGLSPAQRALYRSVMLEIYGNLTSLGYPVPKPALVSLLERGDLPWGLETQDDPPAQGTKHIC

SEQ ID NO: 1099 - protein, 81 aa, Odocoileus virginianus
RPRAVKFGDVALYFSREEWGCLRPAQRALYRDVMQETYGHLGALGCAGPKPALISWLERNTDDWEPAALDPQECPKGVAVQ

SEQ ID NO: 1100 - protein, 81 aa, Rhinolophus ferrumequinum
SEDLVTFRDVAVDFSQEEWEQLNSAQRGLYRDVMLENYRSLVSLGVSVSKPDVISLLEQGKEPWVVKEGTRGTYSDWKYAF

SEQ ID NO: 1101 - protein, 81 aa, Sapajus apella
SQEPVTFADVAVVFTPEEWVFLDSTQRSLYRDVMLENYRNLASVAGDQLRKPNASSDLEQRGEQWNTERGVISDTCPEPQL

SEQ ID NO: 1102 - protein, 81 aa, Balaenoptera acutorostrata
PQVLVSFEEVAVLLSQEEWGRLSPAQKGLYRDVMMETYGNLVSLGLQGSKPDVISKLEQGKEPWAPHSPRIEGSWIWRRRR

SEQ ID NO: 1103 - protein, 81 aa, Rhinopithecus roxellana
PQGSLTFRDVAIEFSQEEWKCLDPIQKALYRDVMLENYRNLGFLGLCLPDLNIISMLEEGKEPWTVVSQVKIARNPNWGEC

SEQ ID NO: 1104 - protein, 81 aa, Rhinopithecus roxellana
VHGSVTFRDVAIDFSQEEWECLQPEQRTLYRDVMLENYSHLISLGSSISKPDVITLLEQEKEPWMVVRKETSRWYPDLESK

SEQ ID NO: 1105 - protein, 81 aa, Macaca mulatta
VHGSVTFRDVAIDFSQEEWECLQPDQRNLYRDVMLENYSHLISLGSSISKPDVITLLEQEKEPWIVVRKETSRWYPDLESK

SEQ ID NO: 1106 - protein, 81 aa, Phyllostomus discolor
MAASQESLTFKDVSVDFSLEEWECLDPAQRKLYSDVMLENYSNLVSLGLVVSKPGLVTFLEQMQEVWDVSRKKSISTPPGR

SEQ ID NO: 1107 - protein, 81 aa, Panthera pardus
AQESLTLEDVAVDFSREEWRLLAPAQKDLYRDVMLENFRNLVSVGHQASKPDVLAKLERGEEPWAIEEEVRSGTSPETGKV

SEQ ID NO: 1108 - protein, 81 aa, Ursus arctos
PQKSVTFEDVAVYFTQTEWDGLSPAQRALYRDVMLENYGNVASLGFSLLKPAVISQLEGAGELEGPSPLVAGTEIGPQGLW

SEQ ID NO: 1109 - protein, 81 aa, Ursus arctos
LLTFEDVAVSFSEEEWKLLDPSQKILYNDVMQENYETVISLGLKLKNDTGNDQPISLSALEIQASGGKVLRKARMKVAQKT

SEQ ID NO: 1110 - protein, 81 aa, Ursus maritimus
AHHLVMFRDVAVDFSQEEWECLNPYQRNLYRDVILENYSNLVSVAGCSISKPDVITLLEQGKEPWMVVRDERRRSLDLESR

SEQ ID NO: 1111 - protein, 81 aa, Physeter macrocephalus
VQESVTFKDVAVLFTQDEWAQLSPAQRALYRDVMLENYSNLVSLGLLGPKPDVFSQLGKGEEWMPEDSLGGFCLDWMTTPV

SEQ ID NO: 1112 - protein, 81 aa, Zalophus californianus
FQDSVTFEDVAVRFSSGEWQCLTRAQRHLYADVMLENYGNMISVGFAVPKPPLISHLEQGAEPCVQDLQDGGFLSCSFPVS

SEQ ID NO: 1113 - protein, 81 aa, Ursus maritimus
SQEPVTFEDVAVYFTQNQWANLDFTQRALYREVMLENYANVASLAFPFPKPDLVSQLERGEAPWGPDPWEAEVLRGVCPGG

SEQ ID NO: 1114 - protein, 81 aa, Ursus arctos
TQGSLSFRDVTVGFTQEEWQHLDPAQRSLYRDVMLENYSHLVSLGYSISKPEVILKLEQGEEPWILEEEFPSQSDLELIKS

SEQ ID NO: 1115 - protein, 81 aa, Pteropus vampyrus
AHGSVIFSDVSIAFSQEEWEYLDLEQRDLYRDVMLENYSNLVSLGCFISKPNVISLLEQGKEPWKVVRKERRYPDMGIRYE

SEQ ID NO: 1116 - protein, 81 aa, Delphinapterus leucas
PENGVTFEDIALYFSWEEWKLLDEAQRRLYHDVMLENFALISSLGVWSGEENVEASFEQSVSVVMSQVRTSKEPSSSQKTH

SEQ ID NO: 1117 - protein, 81 aa, Rhinolophus ferrumequinum
WKEELSFEDVAVNFTREEWNKLDWTQRDLYRDVMLENYRNMILLGFQFPKPEVICQLEQWEDPWILDLPRAGTRKASSNAC

SEQ ID NO: 1118 - protein, 81 aa, Muntiacus muntjak
MGRLMFQDVAIDFTQEEWECLDLSQRDLYRDVMLETYGNLASLGLVVSKPDLVTFLEQMKNPWDVRRTDTKATYPAVSSHN

SEQ ID NO: 1119 - protein, 81 aa, Vicugna pacos
CEVSVSFEDVTVDFSREEWQHLDPAQRRLYRDVTLENYSHLCSVGYQVPKPEVIFKLEQGEGPWTLEEETPHQSCSDEDMG

SEQ ID NO: 1120 - protein, 81 aa, Tursiops truncatus
SKAPVTFGDLAIYFSQEEWEWLSPIQKDLYEDVMLENYQNLVSLGLSFRRPNVITLLEKGKAPWMVEPVKRRRGLDLGSKC

SEQ ID NO: 1121 - protein, 81 aa, Bison bison
KPLAVRFADVAVYFSPEEWGYLRPAQRALYRDVMQETYGHLGALGFPGPKPALISWMEQESEAWSPAAQDPEEGENLGGAL

SEQ ID NO: 1122 - protein, 81 aa, Camelus dromedarius
AQETVTFKDVAVDFTQEEWGQLDPVQRTLYRDVMLETYGHLLSVGNQIAKPEVISLLEQGEEPWSMDRVYPPQRTCPEWMR

SEQ ID NO: 1123 - protein, 81 aa, Leptonychotes weddellii
ARASLSFEDVAVGFSWEEWQLLAPSQKDLYREVMLENYRNLVSVGYQASKPDSLFHLEQGEPPWTVVGAAQSQTCQEIWEI

SEQ ID NO: 1124 - protein, 81 aa, Leptonychotes weddellii
SSQGLLTFRDVAIEFSQEEWGCLNHTQRELYRDVMLENYGHLLFLGLIVSKPDLVSFLEQKKDPWDVKRKKTVAFHPGRWE

SEQ ID NO: 1125 - protein, 81 aa, Leptonychotes weddellii
PQESVTFKDIAVDFTQEEWALLDTSQRKLYRDVMLENISHLVSVGYHLCKSDVISQLEQGVELWREGRGFPQGLNPDRKSG

SEQ ID NO: 1126 - protein, 81 aa, Ovis aries
SQSPLTFGDVAVEFSGEEWAWLDSAQRSLHRSVMLENYRNLASLGLCLSKPEMISSLEQRKEPWAVKRKSTGGECADSQTL

SEQ ID NO: 1127 - protein, 81 aa, Vulpes vulpes
AQESVMFSDVSIDFSQEEWECLNDDQRDLYRDVMLENYSHLVSMGHSVSKPDVISFLEQGKEPWLVDRELTRDQWPVLESR

SEQ ID NO: 1128 - protein, 81 aa, Monodelphis domestica
QVPVTFEDLAVRFSAEEWHLLEEWQREFHRDVMRENYEMLVSLGTAQLLPLSAFLSLTEPQEDMGDNGCSDGEWERPGGGL

SEQ ID NO: 1129 - protein, 81 aa, Cercocebus atys
MEGLVMFQDLFIDFSQEEWECLDTAQKDLYRDVMMENYSSLVSLGLCIPKPDVISLLEQGKEPWMVSRDVLGGWCPDSEFR

SEQ ID NO: 1130 - protein, 81 aa, Neomonachus schauinslandi
PQEPVTFEDVAVYFTQNQWASLDPTQRALYREVMLENYASVASLVFPFPKPDLVSQLERGEAPWGPDPWEAEVLRGICPGG

SEQ ID NO: 1131 - protein, 81 aa, Monodelphis domestica
AQEVVSFKDVAVDFTREEWRLLSPPQKELYKEVMLENARNLLSVGLPAPSEEVISYLEQREAPWILEQEGLRNCCSEGEIR

SEQ ID NO: 1132 - protein, 81 aa, Physeter macrocephalus
YQGLVSFEDVAVNFTWEEWQDLDAAQRTLYRDVMLENYSSLVSLGHCITKPEVIIKLEQGAAPWTVKETPDQGSPDVQIVD

SEQ ID NO: 1133 - protein, 81 aa, Monodelphis domestica
SQGSITFKDVAVDFTQEEWCLLDHSQKALHLEVMLENVQNLLSVGLPVPRENFISCFQQGKAPYLLQQNDPKSSSPEAETN

SEQ ID NO: 1134 - protein, 81 aa, Myotis davidii
SMGSDLFRDVAVVFSREEWERLAPAQRDLYRDVMLETYSHLRSLDLAISKPDVIAFLEQGEEPWRAEEAARDGLCPVDWEC

SEQ ID NO: 1135 - protein, 81 aa, Cercocebus atys
SQGSVSFKDVTVDFTQEEWQQLDPAQKALYRDVMLENYCHFVSVGFHMTKPDMIRKLEQGEELWTQRIFPSYSYLAEDGKT

SEQ ID NO: 1136 - protein, 81 aa, Neomonachus schauinslandi
FEESVTFEDVAVYFSENEWTGLAPAQRVLYRDVMLENYGAVASLAFPFPKPALISQLERGEAPWCKAPQGALDGGGPRGIS

SEQ ID NO: 1137 - protein, 81 aa, Neomonachus schauinslandi
VQGSMSFEDVIVEFTQDEWQYMSPAQRILYRDVMLENYSHLISVGYCTTKPEMIFKLEQGEEPWSLEEEFLNQRYPGYFSV

SEQ ID NO: 1138 - protein, 81 aa, Cercocebus atys
MAQVTFSDVAIDFSHEEWAWLDSAQRDLYKDVMVQNYENLVSVGLSVTKPYVITLLEDGKEPWMVEKKLSKGMIPDWESRW

SEQ ID NO: 1139 - protein, 81 aa, Monodelphis domestica
PQAAMTFQDVAVDFTREEWRLLEPPQKELYWEVMLENYRNLVCLGLTVSKPDVISQLEQGEAPWRLEGGSARGRCLDWGMR

SEQ ID NO: 1140 - protein, 81 aa, Monodelphis domestica
PQELVTFQDVAVYFTPEEVRYLDSYQKALYKDVMLENYGNMASLGFPLSKPVLISQLERGEEPWAMDPLVAKERKTRRGTS

SEQ ID NO: 1141 - protein, 81 aa, Monodelphis domestica
AQEAVTFKDVAVDFTREEWRLLSPPQKELYKEVMLENAQNLLTVGLPAPPENVISALGAEGSPVDARGRRPEGACCPGEII

SEQ ID NO: 1142 - protein, 81 aa, Monodelphis domestica
FQEPVTFKDVAVEFTWEEWRQLDPTQRALFRDVMLENYRNLVSLGLAVTKPDVIFQLESGEVPWMLEREVPRSSPTECLNL

SEQ ID NO: 1143 - protein, 81 aa, Monodelphis domestica
LQASVTFEDVAVDFSAEEWRRLRPLQRELYREVMLENYRSLAWLGLAASKPGVICRLERGEAPREPDPDGPQSGWADCGTG

SEQ ID NO: 1144 - protein, 81 aa, Cercocebus atys
MAFEDVAVYFSQEEWGLLDTAQRALYRRVMLENFTLVTSLGLSTSRPHVVIQLERGEEPWVPSGKDMTLARNTYRRLNAGE

SEQ ID NO: 1145 - protein, 81 aa, Neomonachus schauinslandi
ARASLSFEDVAVGFSWEEWQLLAPSQKDLYREVMLENYRNLVSVGYQASKPDSLFQLEQGEPPWTVVGAAQSQTCQEEIWE

SEQ ID NO: 1146 - protein, 81 aa, Monodelphis domestica
FQGLVTFQDVAVIFSLDEWGHLDPAQRELYREVMLENYQTLACLGLAVSKPDVIAQLEQGGAPWKLEKDIPASPCPGEQYV

SEQ ID NO: 1147 - protein, 81 aa, Physeter macrocephalus
AHVSLSFRDVAIDLSQEEWECLDPVQRALYRDVMLENYSNLVSLGCSSPKPDVITLLEQEKEPWTVMREGTRSWYTDLESK

SEQ ID NO: 1148 - protein, 81 aa, Leptonychotes weddellii
LQEAIVFEDVAVYFTRIEWSCLAPHQRALYRDVMLENYGHMASLGFLVAKPALISLLEQGEEPGALILQGTEEQGSTASLC

SEQ ID NO: 1149 - protein, 81 aa, Leptonychotes weddellii
SQEPVTFEDVAVYFTQNQWASLDPMQRALYLEVMLENYANITSLALPFPKPDLILQLEQGEAPWDLDPWTPLEGEALEGVH

SEQ ID NO: 1150 - protein, 81 aa, Camelus dromedarius
MPQGSVSFKDVTVDFTQEEWQQLDSAQKALYRDVMLENYCHFVSVGFHMTKPDMIHKLEQGKELWTTGRIFPSRSYLGESV

SEQ ID NO: 1151 - protein, 81 aa, Pongo sp.
VQEPVTFKDVAVDFTQEEWGQLDLVQRTLYRDVMLETYGHLLSVGNQIAKPEVISLLEQGEEPWSVEQACPQRTCSEWVRN

SEQ ID NO: 1152 - protein, 81 aa, Pongo sp.
EPGAVSFADVAVYFCREEWGCLRPAQRALYRDVMRETYGHLSALGIGGNKPALISWVEEEAELWDPAAQDPEVAKCQTEAD

SEQ ID NO: 1153 - protein, 81 aa, Leptonychotes weddellii
AHGSVMFNDVSIVFSQEEWEYLDLEQRDLYRDVMLENYSNLVSLGCFISKPDVISLLEQGKEPWKVVRKGRRRYPDLETRY

SEQ ID NO: 1154 - protein, 81 aa, Leptonychotes weddellii
QAEVTFEDVAVLFSREEWGRLGPAQRGLYRDVMLETYRNLVSLGAGPAGPKPGVITQLEQGDEPWVLDAQGAKGKERLRVS

SEQ ID NO: 1155 - protein, 81 aa, Cercocebus atys
RLESVTFEDVAVYFTQNQWASLDPAQRALYGEVMLENYANVASLVAFPFPKPALISHLERGEAPWGPDPWDTKIPRGISQG

SEQ ID NO: 1156 - protein, 81 aa, Enhydra lutris
QEPVTFADVAVLFTPEEWMFLDSAQRSLYRDVMLENYRNLASVGAGDQLGKPSMLSLSEPGEELWAPERRTFPGTRPEPQH

SEQ ID NO: 1157 - protein, 81 aa, Pongo sp.
EMGLLTFRDIAIEFSLAEWQCLDHAQRNLYRDVMLENYRNLVSLGIAVSKPDLITCLEQNKEPRNIKRNEMVAKHPGREKS

SEQ ID NO: 1158 - protein, 81 aa, Otolemur garnettii
LPDSLTFTDVAIDFSQDEWEWLSLAQRSLYRKVMLENYMNLVSVGLCISKPDVISLLEQEKEPWMVTEQITRGLCADLEYM

SEQ ID NO: 1159 - protein, 81 aa, Aotus trivirgatus
AQKVLTFRDVAIEFSLEEWKFLDPAQQNLYRDVMLENYRNLFSIGLTVSKPGLITCLEQRKAPWNLKRREAVDGHIFFAEY

SEQ ID NO: 1160 - protein, 81 aa, Papio anubis
FQGSVSFKDVTVGFSQEEWQHLDPSQRALYRDVMLENYSNLVSVGYCVHKPEVIFRLEQGEEPWRLEEEFPSQSFPEVWTA

SEQ ID NO: 1161 - protein, 81 aa, Neomonachus schauinslandi
AQGHVTFEDVAVYFSWEEWGLLDEAQRLLYRDVMLENFSLMASLGLASSMTHEITQLEWWREPFLPPCGVMTAAMPRDGRQ

SEQ ID NO: 1162 - protein, 81 aa, Monodelphis domestica
PQGSVTFRDVAVNFSQDEWGRLDPSQKELYREVMLENYHNLVCLGLAASKPDVIDQLERGEAPWMPGIGCPDQKIRSDTQE

SEQ ID NO: 1163 - protein, 81 aa, Monodelphis domestica
IQESVTFKDVSVDFTWEEWRHLDPAQRDLYRNVMLENYENLVSVGISVSTVDMISLLEKRDGPWMPEGEVSGAICPDSLNE

SEQ ID NO: 1164 - protein, 81 aa, Sarcophilus harrisii
FQESLTFKDVAVDFTYEEWQQLNPDQRYLYRDVMLENYKNLVFLGHQISKPDVISQLEQGKEPWPIEREIFTYSCRDWETK

SEQ ID NO: 1165 - protein, 81 aa, Cercocebus atys
FQGSVTFTDVAIDFSQEEWRWLQPAQRDLYRCVMLENYGHLVSLGLSISKPDVVSLLEQGKEPWLGKRNVNRDLFSVSESR

SEQ ID NO: 1166 - protein, 81 aa, Physeter macrocephalus
SQSLVTFGDVAVEFSPEEWEWLDSAQRSLYRSVMLENYRSLVSLGLCVSKPKMISSLEQRKEPWAAKRTLTRGGCSDSRAL

SEQ ID NO: 1167 - protein, 81 aa, Monodelphis domestica
AQVLVTFQDVAVDFTQEEWRLLDPGQKELYKEVMLDNAQNMLFLGLPVPREDWFSHFHEGGASWMLEGEDPSNSGLDGERR

SEQ ID NO: 1168 - protein, 81 aa, Monodelphis domestica
PQGLVTFRDVAVDFTREEWRLLSPRQKELYKEVMLENAGNLLSLGLPVPREDVISYFEQKDVPWMLEQKALRSFCPGGPVK

SEQ ID NO: 1169 - protein, 81 aa, Physeter macrocephalus
APLPLTFEDVAVYFSEQEWRNLEAWQKELYKQVMRTNYEILVSLDDGLPKPELISWLEQGRELFKNWGESQKSGNIICFSA

SEQ ID NO: 1170 - protein, 81 aa, Aotus trivirgatus
SQGLVTFGDVAIDFSQEEWEWLSPIQRNLYRKVMLENYRNLASLGLCVSKPDVISLLEQGKEPWTVKRKMTRAGCPDLKAV

SEQ ID NO: 1171 - protein, 81 aa, Leptonychotes weddellii
AHHLVMFRDVAVDFSQEEWECLNSYQRNLYRDVILENYSNLVSVGCSISKPDVITLLEQGKEPWMVVRDERRRRSLDLESR

SEQ ID NO: 1172 - protein, 81 aa, Felis catus
AQESLTLEDVAVDFSREEWRLLAPAQKDLYRDVMLENYRNLVSVGHQASKPDVLARLERGEEPWAIEEEVRSGTSPETGKV

SEQ ID NO: 1173 - protein, 81 aa, Leptonychotes weddellii
PQEPVTFEDVAVYFTQNQWASLDPTQRALYREVMLENYASVASLVFPFPKPDLVSQLEREEAPWGPDPWEAEVLRGICPGG

SEQ ID NO: 1174 - protein, 81 aa, Neomonachus schauinslandi
SLESDVFTDVAIVFSQEEWEQLAPAQRDLYRDVMLETYSNLVSLGLAIAKPDVISFLEEGKEPWVVEKTSRGGLCPVLESR

SEQ ID NO: 1175 - protein, 81 aa, Monodelphis domestica
AQEVVTFQDVAVDFTREEWRLLSPPQKELYKEVMLENARNLLSVGLPAPPDDVVSYLEQREGPSMLDQEDLRTCGPEGEIR

SEQ ID NO: 1176 - protein, 81 aa, Monodelphis domestica
IQGSLTFKDVAVDFTQEEWCLLDHSQKELYLEVMLENVQNLLSVGLPVPREYCTSYFQQEKARWLLEQKCPRSSSPEAETN

SEQ ID NO: 1177 - protein, 81 aa, Monodelphis domestica
PQESVTFEDVAVYFTQKEWEGLAPAQRALYRDVMLENYGNLVSLAFLFPKPAVISQLEQGEKPWIQTPQRPLDKKKTYKGC

SEQ ID NO: 1178 - protein, 81 aa, Monodelphis domestica
SQGSITFKDVAVDFTQEEWCLLDPSQKELYREVMLENVQNLLFVETNFEVKEISTKQSLFVEGSGPPRGKNKGPCDFLLRE

SEQ ID NO: 1179 - protein, 81 aa, Monodelphis domestica
NLEAVTFQDVAVEFTCEEWRHLAPPQKELYRDVMLENYKNLVRLGLAVSKPDVISQLERREAPWMPGGIQRSRCPDWEASC

SEQ ID NO: 1180 - protein, 81 aa, Monodelphis domestica
SQGSITFKDVAVDFTQEEWCLLDHSQKELYLEVMLENVQNLLSVGLPVPRENFISCLQQGKAPWLLAQKDSRNSCLEAKTN

SEQ ID NO: 1181 - protein, 81 aa, Monodelphis domestica
IQGSLTFKDVAVDFTQDEWCLLDNSQKELYLEVMLENVQNLLSVGLPVPREYLTSCFQQGEAPWLLEQEVPRSSCPEAETN

SEQ ID NO: 1182 - protein, 81 aa, Neomonachus schauinslandi
SQGLVTFRDVALDFSQEEWEWLDPSQKDLYRDVMLENYRNLVWLGLSISKPNMISLLEQGKEPWMVEKEMSDGQCADWESW

SEQ ID NO: 1183 - protein, 81 aa, Neomonachus schauinslandi
FQETVTFKDVAVVFSEEELGLLDSTQRKLYRDVMLENFRNLVSVGHSSSKPDMISQLEREEKLCMKEIHTERGRHSGGRNQ

SEQ ID NO: 1184 - protein, 81 aa, Physeter macrocephalus
EEVPVVFEDVAVYFTREEWAALDKRQKELYRDVMRTNYELLASLGPAAAKPDLISKLERRAAPWIRDPDGPEWGKGRPPGK

SEQ ID NO: 1185 - protein, 81 aa, Physeter macrocephalus
FQELVSFKDVTVGFTQEEWQHLDPTQRSLYRDVMLENYSNLVSVGYCVTKPEVIFRLEQGEEPWILEEEFPRQSFPEVWKI

SEQ ID NO: 1186 - protein, 81 aa, Physeter macrocephalus
MAFRDVAVDFTQEEWMLLSPAQRSLYREVMLENYSNLVSLGIPFSKPKLITQLEQGKETWREERKCPPANGPPEPKPELHL

SEQ ID NO: 1187 - protein, 81 aa, Aotus trivirgatus
EPGTVSFGDVAVYFSREEWGCLRPAQRALYRDVMRETYSHLGALGVGGSKPALISWVEEEAELWGPAAQDPEVAKRPTEAD

SEQ ID NO: 1188 - protein, 81 aa, Felis catus
AQAPLSFEDVAVSFSREEWRLLVPAQKDLYRDVMLENYRNLVSVGYQASEPGSLFQLEHAGPLRAVEGAAPRPPCPEEIWE

SEQ ID NO: 1189 - protein, 81 aa, Monodelphis domestica
MLFQELVTFKDVAVDFTQEEWKCLAPSQKELYREVMLENYRNLVSLGRAVSKPELIHQLERGETPWRPKGDGWRNSLRPGE

SEQ ID NO: 1190 - protein, 81 aa, Monodelphis domestica
GQEEVAFKDVAVDFTREEWRLLSPPQKELYKEVMLENIRNLLSVGLPAPPEDMISYLEQREAPWMLEQEGLRSYSPGEEIR

SEQ ID NO: 1191 - protein, 81 aa, Monodelphis domestica
GQEEVTFKDVAVDFTREEWRLLSPPQKELYKEVMVENARNLLSVGLPAPTKDVLSYLKKRGAPVMLEQEGLRNYFPEGEIR

SEQ ID NO: 1192 - protein, 81 aa, Monodelphis domestica
FQESVTFKDVTVNFTQEEWEQLNPAQRELYRDVMLENYRNLISLGLPISKPDVIFQLEQGQEPWMLDVQGTERQAVPRSTS

SEQ ID NO: 1193 - protein, 81 aa, Aotus trivirgatus
VAFEDVAVNFTQEEWALLDPSQKNLYREVMQETLRNLASIGQRWSNQNAEDKHQNPRRNLRRLIGERLFQSKESHQHVEVL

SEQ ID NO: 1194 - protein, 81 aa, Myotis davidii
MVFEDVAVYFSREEWGLLDSAQRALYRQVMLENFALVASLGLSASRPRIVLQLERGEEPWVLSGLDVALARDAQRRPGPGE

SEQ ID NO: 1195 - protein, 81 aa, Cercocebus atys
EELPVVFEDVAVYFTREEWGMLDKRQKELYRDVMRMNYELLASLGPAAAKPDLISKLERRAAPWIKDPNGPKWGKGRPPGN

SEQ ID NO: 1196 - protein, 81 aa, Camelus dromedarius
WKESLSFEDVALYFTREEWSRLDWAQKDLYRDVMLENYRNMIVLGFQFPKPEVICQLEQWEEPWILDLPRAGTRKASGSAC

SEQ ID NO: 1197 - protein, 81 aa, Cercocebus atys
SQESVAFEDVAVYFTTKEWAIMVPAERALYRDVMLENYEAVAFVVPPTSKPALISHLEQGKESCFIRPQGVLSRSDWRAGL

SEQ ID NO: 1198 - protein, 81 aa, Neomonachus schauinslandi
QPREAVTFKDVEVTFSQDEWGWLDPAQRNLYRDVMLENYGNVVSLVGPFTKPVLISWLEAREPWGLNVQGAQPKGKPGVAP

SEQ ID NO: 1199 - protein, 81 aa, Monodelphis domestica
AQVLVTFQDVAVDFTQEEWRLLDPGQKELYKEVMLENAENMLFLGLPVPREDWFFHFHEGGDPWMLEGKGPSISRLDEERH

SEQ ID NO: 1200 - protein, 81 aa, Physeter macrocephalus
AQGLVLFEDVSVDFTQKEWQLLDRTQRLLYRDVMLENYGHLVSLGHCVSKPELILKLEQEEEPWILKGQLASESHPEVQRT

SEQ ID NO: 1201 - protein, 81 aa, Monodelphis domestica
VKEVVTLQDVAVDFTWEEWRLLSPPQKELYREVMLENAQNLLSVGLPAPLEDVLSYLEQRKGPWMLEQKRLRSCCPGEIRL

SEQ ID NO: 1202 - protein, 81 aa, Neomonachus schauinslandi
LQVSVSFEDVTVDFSREEWQHLDPAQRRLYRDVTLENYSHLHSVGYQVPKPEVIFKLEQGEGPWTLEGETPHQGCSDEAIG

SEQ ID NO: 1203 - protein, 81 aa, Monodelphis domestica
FQASVTFKDVAVDFTWEEWRLLDPPQKELFWEVMLENYRNLVCLGLADSNKDVMISELESGEPHWIPTGGVLRSCWPGWES

SEQ ID NO: 1204 - protein, 81 aa, Camelus dromedarius
GQESVSFKDVTVDFTWDEWLQLTGMQRTLYRDVMLENYSHLVSVGCCITKPEVIFKLEQGEEPWPREGELPGRRDPDRSQE

SEQ ID NO: 1205 - protein, 81 aa, Felis catus
FQESVTFEDVAVYFSENEWIGLAPAQRVLYRDVMLENYGVVASLAFPFPKPALISQLERGEAPWCKAPQGAVDGECPRGVS

SEQ ID NO: 1206 - protein, 81 aa, Vulpes vulpes
FQEAVTFKDVAVVFSEEELGLLDPTQRKLYRDVMLENFRNLVSLGHSSSKPDVISQLEREEKLCTKEFHTQGGGRNQKEME

SEQ ID NO: 1207 - protein, 81 aa, Pan troglodytes
FQEPVTFEDVAVYFTQNEWASLHPMQRALHREVMLENYANVTSLSAFPFPKPDLIFQLEQGEAAWGPDPWTLAGGETLRGM

SEQ ID NO: 1208 - protein, 81 aa, Myotis davidii
PNALVTFQDVFVDFSPEELASLSAAQRRLHREVTLENYRNLVSLGYQFPRPDIITQLEEEESSAMEEDSNTKTGPDWETGP

SEQ ID NO: 1209 - protein, 81 aa, Monodelphis domestica
PGQEVVTFKDMAVDFTREEWRLLTPPQKELYKEVMLENARNLLSVGFAVPGDVISYLEQREAPWLLEQEGLRSCSPGDISP

SEQ ID NO: 1210 - protein, 81 aa, Monodelphis domestica
APAPVSFRDVAVDFTRQEWQLLAPAQRALYREVMLENYRNVASLGHPVSKPNVIFQLEQSEAPWMPEGEAARSLPPDWEAR

SEQ ID NO: 1211 - protein, 81 aa, Monodelphis domestica
SITFKDVVVDFTQEEWCLLDPSQKELYREVMLENVQNLFFVEAETNFEVKEMSTKMRLFVEGSNSPRGMKRNPCDFLFREI

SEQ ID NO: 1212 - protein, 81 aa, Pan troglodytes
ALRSVMFSDVSIDFSPEEWEYLDLEQKDLYRDVMLENYSNLVSLAGCFISKPDVISSLEQGKEPWKVVRKGRRQYPDLETK

SEQ ID NO: 1213 - protein, 81 aa, Leptonychotes weddellii
LLTFEDVAVSFSEEEWKLLDPTQKILYNDVMQENYETVISLGLKLKNDTGNDQPISLSALEIQASGCKVLRKARMKVAQKT

SEQ ID NO: 1214 - protein, 81 aa, Monodelphis domestica
GARVLVSFADVAVYFSPEEWGRLRPEQRALYRDVMRETYGHLGALGFPGPKPALISWMEEAAWDSEAKPVIKRLEDVGQPP

SEQ ID NO: 1215 - protein, 81 aa, Monodelphis domestica
RQERVTFGDVAVDFTLDEWVCLDSAQKALYRDVMLENYGHLVCLGLAGAKPAVIQRLERGEAAWCPGVPGSRLPDWETRLE

SEQ ID NO: 1216 - protein, 81 aa, Camelus dromedarius
PLETVTFGDVVLDFTQEEWALLDTSQKKLFRDVMLENIHHLVSVGYQISKSDVILQLEQGKELWREGEGRPQGRGPGSESP

SEQ ID NO: 1217 - protein, 81 aa, Camelus dromedarius
FQESVTFEDVAIYFSENEWTGLAPAQRALYRDVMLENYGAVASLAAFPFPKPALIFQLEQGEAPWSSAPQGALDGEGPRGI

SEQ ID NO: 1218 - protein, 81 aa, Pongo sp.
SKAPVTFGDLAIYFSQEEWEWLSPIQKDLYEDVMLENYRNLVSLGLSFRRPNVITLLEKGKAPWMVEPVRRRRAPGWTTMM

SEQ ID NO: 1219 - protein, 81 aa, Callithrix jacchus
ASGTLTFDDVALYFSEQEWEILEKWQKQMYKQEMKTNYETLDSLGYAFSKPDLITWMEKGRMLLISDQGRLHKTKRTAGPP

SEQ ID NO: 1220 - protein, 81 aa, Ovis aries
HQEVVTFEDVAVYFTQTEWAGLSPAQRALYRSVMLEIYGNLTSLGYPVPKPALVSLLERGDLPVGLETQDNPPAQGTRDIY

SEQ ID NO: 1221 - protein, 81 aa, Enhydra lutris
HQGLLTFRDVAVEFSLEEWGRLTHTQRQLYRDVMLENYGHLLFLGLIVSKPDLVSFLEQKKEPWNLKRKKTVAFHPAISSH

SEQ ID NO: 1222 - protein, 81 aa, Enhydra lutris
RPGAVSFADVAVYFSPEEWGCLRPAQRALYRDVMRETYGHLGALGFAGSKPALISWLERKKEVWSPEAEDPEDGARHPGSG

SEQ ID NO: 1223 - protein, 81 aa, Pongo sp.
SKAPVTFGDLAIYFSQEEWEWLSPIQKDLYEDVMLENYRNLVSLGLSFRRPNVITLLEKGKAPWMVEPVRRRRAPELTEAS

SEQ ID NO: 1224 - protein, 81 aa, Pongo sp.
CYQDSVTFDDVAVDFTQEEWTLLDSTQRSLYSDVMLENYKNLATVGGQIIKPSLISWLEQEESKTVQGGVLQGRKTQWRGT

SEQ ID NO: 1225 - protein, 81 aa, Enhydra lutris
SQSLVTFGDVAVDFSREEWEWLSSAQRTLYRTVMLENYRNLVSLGLCISKPDMISSLEQRKEPWMAKRKLTRGRCPDLKIV

SEQ ID NO: 1226 - protein, 81 aa, Pongo sp.
ACGSITFRDVAIDFSHQEWEYLNLVQKTLYQEVMMENYDNLVLLGHSKSKPDLITLLEQGKEPWMIVREETRGECTAELQS

SEQ ID NO: 1227 - protein, 81 aa, unidentified
  source 1..81: note = Bos indicus x Bos taurus
HQEVVTFEDVAVYFTRTEWAGLSPAQRALYRSVMLEIYGSLTSLGYPVPKPALISLLERGDLPVGLETQDNPPAQGTRDIY

SEQ ID NO: 1228 - protein, 81 aa, Vulpes vulpes
FQGSVSFKDVTVGFTLEEWQHLDSTQRSLYRDVMLENYSNLVSLGYCVTKPEVIFRLEQGEEPWILEEEFPSQSFPESWET

SEQ ID NO: 1229 - protein, 81 aa, Otolemur garnettii
SVMFNDISIVFSQEEWEYLDLEQKDLYKDVMLENYGNLVSLGCFIAKPDVISLLEQGKEPWKVIRKGRRGYPDLETRYETK

SEQ ID NO: 1230 - protein, 81 aa, Otolemur garnettii
GTVVFSDVSVDFSQEEWECLDPVQRDLYREVMLENYSNLVSVGAGPYIPKPQVISLLEQGKEPWMVGRELTRGLCSDLESM

SEQ ID NO: 1231 - protein, 81 aa, Enhydra lutris
PQDLMTFEDVAVEFTQWEWGQLDPAQKDLYRVVMLENFKNLASLGFPVAKPYVISQLEKGKEPCVLEGEISTDWEKRPKAK

SEQ ID NO: 1232 - protein, 81 aa, Camelus dromedarius
TPEPVRFADVAVYFSLEEWGCLQPAQRALYRDVMRETYGHLGALGFRGTKPALISWVEKEAELWGPDARDPEVGECLTEAD

SEQ ID NO: 1233 - protein, 81 aa, Camelus dromedarius
PQGLVTFGDVAVDFSQEEWEWLDCAQRTLYRSVMLENYRSLVSLGLCVSKPEMISSLEQRKEPWTVKRKCTRGQCPDSEAV

SEQ ID NO: 1234 - protein, 81 aa, Myotis davidii
EPVTFKDVAVVFSEEELGLLDSVQRKLYRDVTLENFRNLVSVGHLFSKPDVISQLEREEQLWMTEIQTQRGGHSAENCAAR

SEQ ID NO: 1235 - protein, 81 aa, Pongo sp.
YEEMVTFEDVAVHFTKTEWTGLSPAQRALYRSVMLENFGNLTALGYPVPKPALISLLEGGDMAWGLEAQDDPLAEMTKNVC

SEQ ID NO: 1236 - protein, 81 aa, Monodelphis domestica
AQEMVTFQDVAVDFTREEWCLLSPPQKELYKEVMLENARNLLSVGLPALPEDVISYLEQREAPWMLEREGPRSCCPGEILL

SEQ ID NO: 1237 - protein, 81 aa, Monodelphis domestica
EELPVVFEDVAVYFTREEWAMLDKRQKELYRDVMRMNYELLASLGPAAPKPDLILKLERRAAPWIKDPNGPKWGKGRPPGK

SEQ ID NO: 1238 - protein, 81 aa, Physeter macrocephalus
MTFEDVAVEFTRWEWGQLDPTQKDVYREVMLENFKNLASLGFPMSKPYVICRLEEGEEPCILEREISTGAPADWERRRQAK

SEQ ID NO: 1239 - protein, 81 aa, Monodelphis domestica
IQGSLTFKDVAMNFTQEEWCLLDHSQKELYLEVMLENVQNLLSVGLPVPREYYTSYFQQEKAPWLLVQKGPRNSSPEAETN

SEQ ID NO: 1240 - protein, 81 aa, Monodelphis domestica
PPRQERVTFGDVAVDFTLDEWVCLDSAQKALYRDVMLENYGHLVCLGLAGAKPAVIQRLERGEAAWCPGVPGSRLPGLFFF

SEQ ID NO: 1241 - protein, 81 aa, Monodelphis domestica
FQESVTFKDVAVDFTQEEWKQLDPAQRDLYRDVMLENYRNLVSLGLPVFKPDVISQLERGEAPWIPEVPRSICQGEVVRTR

SEQ ID NO: 1242 - protein, 81 aa, Aotus trivirgatus
METLTFRDVAIEFSLEEWQCLDIAQQDLYRKVMLENYRNLAFLGIALTKPDLITCLEQRKVPWNMKRHEMADEPPVLCSNF

SEQ ID NO: 1243 - protein, 81 aa, Monodelphis domestica
PQASVTFKDVAVDFTWEEWRLLDPSQKELFWEVMLENYRNLVCLGLADSNKDVRISELESGEPHWIPTGGVLRSCWPGWES

SEQ ID NO: 1244 - protein, 81 aa, Monodelphis domestica
PAQVLVTFKDVAVDFTQEEWRLLDPHQKELYKEVTLENAWNMLSMGLPVPRDLVSHFKQVEAPWMLEEEGSSNSCLDGERR

SEQ ID NO: 1245 - protein, 81 aa, Monodelphis domestica
PQELVTFRDVAVDFTPEEWGQLGPAQKELYQEVMLENYRNLVCLGLTVSKPDVISQLEQGEAPWRLEGGSARGRCLDWGMR

SEQ ID NO: 1246 - protein, 81 aa, Monodelphis domestica
CQETLTFKDVAVDFTREEWGQLGPAQRDLYKEVMLDNYRNLISLGLQGSKPDVIFWLERGQSPWTLKRRKSRDCCPEFHLH

SEQ ID NO: 1247 - protein, 81 aa, Monodelphis domestica
PQELVTFEDVAVYLTKEEWEHLGPAQRRLYRDVMLENYENVVSLGFPVSKPDLISQLEQGEVPCLPDLPRTEVPEIHGGPL

SEQ ID NO: 1248 - protein, 81 aa, Papio anubis
FQGSVTFRDVAIDFSQEEWKWLQPAQRDLYRCVMLENYGHLVSLGLSISKPDVVSLLEQGKEPWLGKRNVNRDLQALCIPI

SEQ ID NO: 1249 - protein, 81 aa, Papio anubis
AQMLVTFKDVAVTFTQEEWRQLDLTQRTLYREVMLETCGLLVSLGHRVPKPELVHLLEHGQELWTVKRGLSDPTCAGDRTQ

SEQ ID NO: 1250 - protein, 81 aa, Monodelphis domestica
MELVTFEDVAVYFTRKEWGWLDPAQRDLYRDVMLENYGNFVSMGLPFSKPDVISQLEQGEESWVEDLQECEEGEFSPVVHS

SEQ ID NO: 1251 - protein, 81 aa, Monodelphis domestica
AWEVVTFQDVAVDFTREEWRLLSPPQKELYKEVMLENVRNLLSVGLPAPPDDVVSYLEQREGPSMLDQEDLRTCGPEGEIR

SEQ ID NO: 1252 - protein, 81 aa, Monodelphis domestica
QLGSVAFEDVAVDFTQEEWGYLAPAQRDLHREVMLENYRNLVFLGLVASKPDVICHLEQRKEPWSLRGIEKRKALRGTCPD

SEQ ID NO: 1253 - protein, 81 aa, Monodelphis domestica
AQVLVTFQDVAVDFTQEEWRLLDPGQKELYKEVMLENVQNVLSLGLPVPREDWFFHFHEGGDPWMLEGKGPSISRLDEERH

SEQ ID NO: 1254 - protein, 81 aa, Monodelphis domestica
SQVSLTFRDVAVDFSQEEWGLLEPAQKDMYRDVMLENYENFLSLGLPISKPNMISQLKRREAPSWIAEGKVSLSTYLGTLR

SEQ ID NO: 1255 - protein, 81 aa, Physeter macrocephalus
FQEPVSFKDVSVVFTEEELGLLDSAQRKLYRDVMLENFQNLLSVGNQPFKPELIFQLEREEELLMMETETQRDGCSGTKSQ

SEQ ID NO: 1256 - protein, 81 aa, Lipotes vexillifer
SLGSDLFRDVAVVFSQEEWEQLAPAQRDLYRDVMLEIYSNLVSLGFAISKPDVISFLEQGREPWMVEKVVTGGQCPVLESR

SEQ ID NO: 1257 - protein, 81 aa, Monodelphis domestica
SEETVTFKDVAVDFTWEEWKQLTPVQRDLYRDVMLENYQNLVSLGLPVFQSDLISQLERGEVPWIPEGETFRGPCPGSINQ

SEQ ID NO: 1258 - protein, 81 aa, Otolemur garnettii
LQGSVSFKDVTVDFTQEEWQQLDPAQKALYRDVMLENYCHFVSVGFHMTKPDMIRRLEQGEELWTERIFPGQSYLEEDGKA

SEQ ID NO: 1259 - protein, 81 aa, unidentified
  source 1..81: note = Bos indicus x Bos taurus
TQVSVTFDDVAVTFTQEEWGHLDPAQRTLYREVMLETCRLLVSLGCPVPRPELIYRLEHGQELWTVKRDLSRSTCAVDEGK

SEQ ID NO: 1260 - protein, 81 aa, Pan troglodytes
EPGAVSFADVAVYFSPEEWECLRPAQRALYRDVMRETYGHLGALGFPGPKPALISWMEQESEAWSPAAQDPEKGERLGGAR

SEQ ID NO: 1261 - protein, 81 aa, Otolemur garnettii
FQGPVTFRDVAIDFSQEEWKWLQPAQRDLYRCVMLENYGHLVSLGLSISKPDVVSLLEQGKEPWLEQGDVRRNLFSVSQSN

SEQ ID NO: 1262 - protein, 81 aa, Enhydra lutris
LQEPVTFADVAVLFTPEEWMFLDSAQRSLYRDVMLENYRNLASVGDQLGKPSMLSLSEPGEELWAPERRTFPGTRPEPQHQ

SEQ ID NO: 1263 - protein, 81 aa, Pongo sp.
RRESVTFEDVAVYFSENEWIGLGPAQRALYRDVMLENYGAVASLAFPFPKPALISQLERGETPWCSVPQGALDGEAPRGIS

SEQ ID NO: 1264 - protein, 81 aa, Pongo sp.
MVTFEDVAVHFTKTEWTGLSPAQRALYRSVMLENFGNLTALGYPVPKPALISLLEGGDMAWGLEAQDDPLAETTKNVCKDV

SEQ ID NO: 1265 - protein, 81 aa, Pan troglodytes
FEELVTFEDVLVDFSPEELSSLSAAQRNLYREVMLENYRNLVSLGHQFSKPDVISRLEEEESHAMETDSRHTVICPGESHD

SEQ ID NO: 1266 - protein, 81 aa, Enhydra lutris
RPRAVKFADVAVYFSPEEWGCLRPAQRALYRDVMRETYGHLSALGCSGPKPALISWLERNTDDWEPAALDPQECPRGLTVQ

SEQ ID NO: 1267 - protein, 81 aa, Zalophus californianus
SLESDLFRDVAIVFSQEEWEQLAPAQRDLYRDVMLETYSNLVSLGLAIAKPDVISFLEQGKEPWVVEKMSRGGLCPVLESR

SEQ ID NO: 1268 - protein, 81 aa, Rhinolophus ferrumequinum
SQGLVTFRDVALDFSQEEWEWLDPSQKDLYRDVMLENYRNLVCLGLSISKPNMISLLEQGKEPWMVQREMSDDPYTDWESW

SEQ ID NO: 1269 - protein, 81 aa, Rhinopithecus roxellana
EMVTFKDVAVVFTEEELGLLDSAQRKLYRDVMLENFRNLLLVAHQPFKPDLISQLEREEKLLMVEMETPKDGCSGRKNQQK

SEQ ID NO: 1270 - protein, 81 aa, Zalophus californianus
PQESVTFKDIAVDFTQEEWALLDTSQRKLYRDVMLENISHLVSVGYHLCKSDVVSQLEQGVELWREGRGFPQGPNPDRKSG

SEQ ID NO: 1271 - protein, 81 aa, Panthera pardus
AQGSVVFSDVSVDFSQEEWECLDSGQRDLYRDVMLENYSNLLSMGFYIPKPPVISLLEQGKEPWMVGRELTKGLCSDLESM

SEQ ID NO: 1272 - protein, 81 aa, Vicugna pacos
SKAPVTFGDLAIYFSQEEWEWLSPIQKDLYEDVMLENYQNLVSLGLSFRRPNVIALLEKGKAPWMVEPVKRRRGLDSGSKC

SEQ ID NO: 1273 - protein, 81 aa, Zalophus californianus
ARASLSFEDVAVGFSWEEWQLLAPSQKDLYRDVMLENYRNLVSVGYQASKPDSVFQLEQGEPPWMVEGAAQSQTCQGYPAT

SEQ ID NO: 1274 - protein, 81 aa, Callorhinus ursinus
SHGPLSFEDVAIAFTKEEWQQLDPAQRTLYRDVMLENFSHLVSLGHPVSKPDIISKLEQGEEPWIIKRHISDWICPERETR

SEQ ID NO: 1275 - protein, 81 aa, Zalophus californianus
SQEPVTFEDVAVYFTQNQWASLDPMQRALYLEVMLENYANITSLAALPFPKPDLILQLEQGGAPWGLDPWTPLEGEALGGV

SEQ ID NO: 1276 - protein, 81 aa, Pan paniscus
MLMMFRDVAVDFSQEEWECLDLEQRGLYRDVMLENYSNMVSLGLCIYQPEAFSLLEKGKEPWKILRDETRGPCPDMQSRCQ

SEQ ID NO: 1277 - protein, 81 aa, Tursiops truncatus
QAEVTFEDVAVLLSREEWGRLGPVQKGLYRDVMLETYRNLVSLGAGPAGPKPEVITQLERGDEPWVPDVQGRERPTIDGSA

SEQ ID NO: 1278 - protein, 81 aa, Tursiops truncatus
EEVPVVFEDVAVYFTREEWGTLDKRQKELYRDVMRMNYELLASLGPAAAKPALISKLERRAAPWIQDPNGPKWGKGRPPGK

SEQ ID NO: 1279 - protein, 81 aa, Panthera pardus
PQEPVTFEDVAVYFTQNQWASLDPMQRALYREVMLENYTNMASLAFPFPKPVLVSHLERGEAPWGPDPWEAEVLRGICPGG

SEQ ID NO: 1280 - protein, 81 aa, Tursiops truncatus
FQVLVSFEEVAVLLSQEEWGHLGPAQKRLYRDVMLETYGNLVSLGLQGSKPDVISKLEQGEEPWTPHSPRIEGSWIRRRRP

SEQ ID NO: 1281 - protein, 81 aa, Leptonychotes weddellii
AQESVVFSDVSIDFSQEEWECLNDDQRDLYRDVMLENYSHLVSMAGHSVSKPDVISVLEQGKEPWLVDRELTREQWPVLES

SEQ ID NO: 1282 - protein, 81 aa, Physeter macrocephalus
KSAAVSFSDVAVYFSLEEWGCLRPAQRALYRDVMRETYGHLGALGFPGPKPALISWMEQESEAWSPAAQDPEEGESLGGAL

SEQ ID NO: 1283 - protein, 81 aa, Carlito syrichta
LQGSVSFKDVTVDFTQEEWHQLNPAQKALYRDVMLENYCHFISVGFHMTKPDMIRKLEQGEELWTERIFSRQSHLEEDGKA

SEQ ID NO: 1284 - protein, 81 aa, Tursiops truncatus
SQSLVTFGDVAVEFSPEEWEWLDSAQRSLYRSVMLENYRSLVSLGLCVSKPKMISSLEQRKEPWVAKRTLTRGGCPDSRAL

SEQ ID NO: 1285 - protein, 81 aa, Panthera pardus
PQEPVTFEDVAVLFTPEEWMFLDSAQRSLYRDVMLENYRNVASVGDQLGKFSSFSHLEQGEEWWPTERRVFPGSCPEPSLP

SEQ ID NO: 1286 - protein, 81 aa, Phascolarctos cinereus
FQVSVTFQDVAVDFSRDEWKRLDDAQKALYRDVMLENYENLVSLGLPVSKLDVISLLERREAPRRAKERVPRDLPPDSISQ

SEQ ID NO: 1287 - protein, 81 aa, Physeter macrocephalus
HQEVVTFEDVAVYFTQTEWAGLSPAQRALYRSVMLEIYGNLTSLGYPVPKPALVSLLERGELPWGLETRDDPPAQGTKDIC

SEQ ID NO: 1288 - protein, 81 aa, Acinonyx jubatus
FQDFVSFNDVSVNFTEEEWRELDPVQRVLYRDVMLENYRNLVSLGFPFSKPDIISQLEQAVNPWMQEGEVLRGSCTHLETR

SEQ ID NO: 1289 - protein, 81 aa, Sus scrofa
FQEAVTFKDVAVTFTEEELGLLDSTQRKLYRDVMLENFRNLLLVGNQPFKPELIFQLEREEMLLMLETEIQRGTKSHHSLE

SEQ ID NO: 1290 - protein, 81 aa, Odocoileus virginianus
SKAPVTFGDLAIYFSQEEWEWLSPIQKDLYEDVMLENYQNLVSLGLCFRRPNVITLLEKGKAPWMVDPVKRRRGLDLGSKG

SEQ ID NO: 1291 - protein, 81 aa, Trichechus manatus
ARESVVFSDVSIAFSQEEWAHLDLEQKDLYRDVMLENYSNLVSLAGCFVSKPDVISLLEQGKEPWKIVRKGRRRYPDLETR

SEQ ID NO: 1292 - protein, 81 aa, Pteropus vampyrus
SQEPVSFLDVAVDFTQEEWQQLDPVQRTTYRDVMLENYSHLVALGYDSAKPNVIVKLEQGEEPWVAEGDLPCRSRPEEVWQ

SEQ ID NO: 1293 - protein, 81 aa, Vicugna pacos
SQHLVTFEDVAVNFTQEEWTLLDQTQRDLYRDVMLENYQNLMALAGSESCKPHVNSPLEGAEELRTRARRILQSEFMAESD

SEQ ID NO: 1294 - protein, 81 aa, Phascolarctos cinereus
PQELVTFEDVAVYLSKEEWGLLDPAQRRLYRDVMLENYGNVASLGLPVSKPDLISQLERTDLPLVPRLPQTEIEDLFDEKL

SEQ ID NO: 1295 - protein, 81 aa, Cercocebus atys
LKGLVTFEDVAVEFTQEEWALLDPAQRTLYRDVMLENFRNLASLGDQVDKPGLIAQLEQEDKVMTEERGILPGTCPDVENP

SEQ ID NO: 1296 - protein, 81 aa, Callithrix jacchus
KPGAVSFADVAVYFSPEEWGCLRPAQRALYRDVMRETYGHLGALGFPGPKPALISWMEQESEAWSSAAQDPENGESLGGAR

SEQ ID NO: 1297 - protein, 81 aa, Callithrix jacchus
EQEPVTFKDVAVDFTQEEWGQLDLVQRTLYRDVMLETYGHLLSVGNQTAKPEVISLLEQGEEPWSVEQTCPQRACPEWMRN

SEQ ID NO: 1298 - protein, 81 aa, Panthera pardus
SQGTVSFKDVAVNFTQEEWQYLDLPQRDLYKDVMLENYTNLISVGYQTTKPSVIHKLEQGEEPWMVEREIPNWSYAEETWQ

SEQ ID NO: 1299 - protein, 81 aa, Cebus imitator
MVSFEDVAVLLSQEEWDCLIPAQRGLYRDVMLETYGNLVSLGLQASKPDVISRLEQGDEPWTTHTLRTQGSWSWRHKREGY

SEQ ID NO: 1300 - protein, 81 aa, Vicugna pacos
AQETVTFKDVAVDFTQEEWGQLDPVQRTLYRDVMLETYGHLLSVGNQIAKPEVISLLEQGEEPWSMERVYPPQRTCPEWMR

SEQ ID NO: 1301 - protein, 81 aa, Pteropus vampyrus
SKASVTFADLAVYFSQEEWEGLSPIQKDLYEDVMLETYQNLVSVGLSCRRPSVITLLEKGKAPWTVEPARQRRGPDSGAKC

SEQ ID NO: 1302 - protein, 81 aa, Ursus arctos
WKELLSFEDVAMYFTREEWNRLDWAQKDLYRDVMLENYRNMILLGFQFPKPEVICLLEQWEEPWILDLPRAGTRKASSSAC

SEQ ID NO: 1303 - protein, 81 aa, Saimiri boliviensis
ALRSVMFSDISIDFSPEEWEYLDLEQKNLYRDVMLENYSNLVSLGCFISKPVVISLLEQGKEPWKVVRKRRQYPDLETKYE

SEQ ID NO: 1304 - protein, 81 aa, Physeter macrocephalus
SQESVSFEDVAVYFTQNQWASLDSAQRTLYRKVMLENYANVTSLAAFPFPKPDLILQLEQGEAPGGLDPWTPIRREVRGVC

SEQ ID NO: 1305 - protein, 81 aa, Sus scrofa
LVFEDVAINFTPEEWALLDPAQRRLYRDVMLETFKNLAFVGSCLHVKTSGSSAQRDILENVLCSEEKIVRFKRNDSKSVLG

SEQ ID NO: 1306 - protein, 81 aa, Nomascus leucogenys
MEGLVMFQDLSIDFSQEEWECLDAAQKDLYRDVMMENYSSLVSLGLSTPKPDVISLLEQGKEPWMVSRDVLGGWCPDRLKK

SEQ ID NO: 1307 - protein, 81 aa, Trichechus manatus
FQESVVFSDVSIAFSQEEWAHLDLEQKDLYRDVMLENYSNLVSLGCFVSKPDVISLLEQGKEPWKIVRKGRRRYPDLETRY

SEQ ID NO: 1308 - protein, 81 aa, Equus caballus
PPSLVTFGDVAIDFSQEEWEWLNSAQRTLYRNVMLENYRNLASLGLCGSKPDMISSLEQRREPWITKRKLTRGRCPDLKAV

SEQ ID NO: 1309 - protein, 81 aa, Mandrillus leucophaeus
EKGPLTFRDVVIEFSQEEWQCLDTAQQDLYRKVMLENFRNLVFLGIDVSKPDLITCLEQGKNPWNMKRHSMVATPPGVFFV

SEQ ID NO: 1310 - protein, 81 aa, Nomascus leucogenys
PQKSVTFEDVAVYFTQAEWDGLSPAQRTLYRDVMLENYGNVASLGFPLLKPAVISQLEGGGDLGGPSPLAAGTGLQGLRTV

SEQ ID NO: 1311 - protein, 81 aa, Chlorocebus sabaeus
KPGTVSFADVAVYFSREEWGCLRPAQRALYRDVMRETYGHLGALGVGGSKPALISWVEEAAELWDPAARDPEVTKCPTETD

SEQ ID NO: 1312 - protein, 81 aa, Mandrillus leucophaeus
VHGSVTFRDVAIDFSQEEWECLQPEQRTLYRDVMLENYSHLISLGSSVSKPDVITLLEQEKEPWIVVRKETSRWYPDLESK

SEQ ID NO: 1313 - protein, 81 aa, Sus scrofa
CKESVIFKDVCVNFSLEEWECLDLTQRNLYRCVMLENYSNLVSVVGLSIPKPDVISLLEQGKEPWGVFDSEMTRGLNQDCG

SEQ ID NO: 1314 - protein, 81 aa, Chrysochloris asiatica
RREPVTFEDVAVYFSENEWSSLAPAQRALYRDVMLENYGAVASLAFSFPKPALISQLERGEAPWSLAPQGALDGEGSRGIS

SEQ ID NO: 1315 - protein, 81 aa, Suricata suricatta
KPGAVSFADVAVYFSPEEWGCLRPAQRALYRDVMRETYGHLGALGFRGTKPALICWVEEEADLWGPEARDPEVGACLTEAD

SEQ ID NO: 1316 - protein, 81 aa, Sus scrofa
SQVSVTFEDVAVLFSRDEWRRLGPSQKNLYQDVMLENYSNLVSLGLPFSKPKVISLLQQGEDPWKVEKESPGSFPGCKSSP

SEQ ID NO: 1317 - protein, 81 aa, Neophocaena asiaeorientalis
SQGSVTFRDVAVDFSREEWEWLQPAQRDLYRHVMLENYGHLVSLGLNISKPHVVSLLEQGKEPWLGKDASRGLFSASESNG

SEQ ID NO: 1318 - protein, 81 aa, Suricata suricatta
AHGSLMFSDVSIVFSQEEWECLDLEQRDLYRDVMLENYTNLVSLGCFISKPDVISLLEQGKEPWKVVRKRRGQYADLETRY

SEQ ID NO: 1319 - protein, 81 aa, Mandrillus leucophaeus
SKAPITFGDLAIYFSQEEWEWLSPIQKDLYEDVMLENYRNLVSLGLSFRRPNVITLLEKGKAPWMIEPVRRRRAPELTEAS

SEQ ID NO: 1320 - protein, 81 aa, Suricata suricatta
QAEVTFEDVAVLFSREEWGRLGPAQRGLYRDVMLETYRNLASLGAGRAGSKPGVITQLERGDEPWVLDAQGAKGKGQPRVS

SEQ ID NO: 1321 - protein, 81 aa, Mandrillus leucophaeus
VHGSVTFRDVAIDFSQEEWECLQPDQRTLYRDVMLENYSHLISLGSSISKPDVITLLEQEQEPWMVVRKETNRWYPDLESK

SEQ ID NO: 1322 - protein, 81 aa, Chrysochloris asiatica
LQEAVTFKDVAVVFSEEELGLLDSAQRTLYRDVMLETFQNLVSLGHQPFKPDVISQLEREEMLWMKGLQTGRGRCSGGRNQ

SEQ ID NO: 1323 - protein, 81 aa, Sus scrofa
CKESVIFKDVCVNFSLEEWECLDLTQRNLYRCVMLENYSNLVSVGLSIPKPDVISLLEQGKEPWGVFDSEMTRGLNQDCGS

SEQ ID NO: 1324 - protein, 81 aa, Suricata suricatta
KPGVLTFADVAVYFSSEEWGCLRPAQRALYRDVMRETYGHLGALGFPGPKPALISWMEQESEESEAWSPAAKDPEEGESLG

SEQ ID NO: 1325 - protein, 81 aa, Mandrillus leucophaeus
GPLTFRDVAIEFSQEEWKSLDPVQKALYWDVMLENYRNLVFLGILPKCMTKELPPIGNSNTGEKFQRVMLERHECYDIENF

SEQ ID NO: 1326 - protein, 81 aa, Pan paniscus
SPGLLTFRDVVIEFSLEEWQCLDHAQQNLYRDVMLENYRNLVSLGIAVSKPDLITCLEQNKDPWNIKRNEMVTKHPVMCSH

SEQ ID NO: 1327 - protein, 81 aa, Equus caballus
MIESQISFEDVAVDFTLEEWQLLNPTQKNLYRDVMLENYSNLAFLGYQIIKPDAVFQLEQEEQWITDEEILNHSCPEEVWL

SEQ ID NO: 1328 - protein, 81 aa, Sarcophilus harrisii
SQIPLTFQDVAVDFTWEEWGLLEPSQKDMYWDVMLEIYENFISLGGVPLSIPDVISQLERMEAPWMTQGGVLISTFLDSST

SEQ ID NO: 1329 - protein, 81 aa, Zalophus californianus
SQGLVTFRDVALDFSQEEWEWLDQSQKDLYRDVMLENYRNLVWLGLSISKPNMISLLEQGKEPWMVEKEMSDGQCADWDSW

SEQ ID NO: 1330 - protein, 81 aa, Loxodonta africana
KPGVVRFVDVAVYFSPEEWACLRPAQRALYRDVMRETYGHLGALGFPGPKPALISWMEQENEAWSPAAQDPEERENLGGVP

SEQ ID NO: 1331 - protein, 81 aa, Pteropus vampyrus
FQGSVMFRDVSINFSQEEWECLDPGQMNLYKEVMLENFSNLVSVGLSSAKPVVISLLEEGKEPWMVEREVKRGLCSDLESM

SEQ ID NO: 1332 - protein, 81 aa, Trichechus manatus
LKASVSFKDVAVELTQEEWQHMGPAQRTLYRDVMLENYSHLVSVGYCIFKPEVIFKLEQGEQPWFLEQEFSNQSYPEDYNI

SEQ ID NO: 1333 - protein, 81 aa, Neovison vison
SKVPVTFGDLAIYFSQEEWEWLHPAQRDLYRHVMLENYGHLVSLGLNISKPYVVSLLEQGRDPWLDNRDVRRDLFSESKGE

SEQ ID NO: 1334 - protein, 81 aa, Callorhinus ursinus
FQESVTFEDVAVYFSENEWTGLAPAQRVLYRDVMLENYGAVASLAAFPFPKPALISQLERGEAPWCKAPQGALDGEGPRGV

SEQ ID NO: 1335 - protein, 81 aa, Suricata suricatta
AQESVTFRDVAVVFSRDEWLCLDPAQRSLYREVMLENYGTLVSLGILFSKPKVIFQLQQGEDPWMVESGVSQGPCVGWESM

SEQ ID NO: 1336 - protein, 81 aa, Sarcophilus harrisii
PQECVTFKDVAVNFTQEEWQQLNPAQRDLYREVMLENYRNLISLGLPVSKPDVIFQLEQGEEPWMLDLQRIEEGEISRNMY

SEQ ID NO: 1337 - protein, 81 aa, Sarcophilus harrisii
LQESVTFSDVAVDFTLEEWGCLCPPQKEMYREVMLENYGNLVCLGLAMSKPDVISRLERGEAPRSPGGDLGSADWGTESGA

SEQ ID NO: 1338 - protein, 81 aa, Callorhinus ursinus
SQEPVTFEDVAVYFTQNQWASLDPMQRALYLEVMLENYANITSLALPFPKPDLILQLEQGEAPWGLDPWTPLDGEALGGVH

SEQ ID NO: 1339 - protein, 81 aa, Tursiops truncatus
TQVSVTFDDVAVTFTQEEWRQLDPAQRTLYQEVMLENCRLLVSLGCPVPRLELIFQLEQGQKLWTVKKDLSRSTCPGKRCR

SEQ ID NO: 1340 - protein, 81 aa, Sarcophilus harrisii
PQGPVTFQDVAVVFTQEEWRYLDPSQKELYRDVMLENYRNLLYLGLVVSKPNVIYRFEQGEASWRPDQRDSGSTCSDEETG

SEQ ID NO: 1341 - protein, 81 aa, Pteropus vampyrus
MEPVTFEDVAVYFTQNQWASLDPVQRALYREVMLENYANVASLAFPFPKPVLISQLEQGEAPWGPDPGEAEVLKGIWPGGE

SEQ ID NO: 1342 - protein, 81 aa, Mandrillus leucophaeus
FEELVTFEDVFVDFSPEELSSLSAAQRNLYREVMLENYRNLVSLGYQFSKPDIISRLEAEESRAMEKDSRHTVICQGEAHD

SEQ ID NO: 1343 - protein, 81 aa, Aotus trivirgatus
PQDLMTFDDVAVEFTQWEWGQLNPAQKDLYREVMLENFRNLTLLGLLVSKPYMICQLEEGGEPFMVNTEISVGAHSDWERR

SEQ ID NO: 1344 - protein, 81 aa, Lipotes vexillifer
QAEVTFEDVAVLLSREEWGRLGPVQKGLYRDVMLETYRNLVSLGAGPAGPKPEVITQLERGDEPWVPDVQGREQPTIDGSA

SEQ ID NO: 1345 - protein, 81 aa, Zalophus californianus
SQEPVTFEDVAVYFTQNQWASLDPMQRALYLEVMLENYANITSLALPFPKPDLILQLEQGGAPWGLDPWTPLEGEALGGVH

SEQ ID NO: 1346 - protein, 81 aa, Equus caballus
TSAPVTFGDLAIYFSQEEWEWLSPVQKALYEDVMLENYQTLASLGLSFRRPNVITLLEKGKAPWMVEPVRRRRGLDSGSKC

SEQ ID NO: 1347 - protein, 81 aa, Equus caballus
RQEPVTFEDVAVYFTQNEWVILDPAQRALYREVMLENYANVASLAFSFTRPVLVSQLERGELPPGLDPWERASPEALRGIC

SEQ ID NO: 1348 - protein, 81 aa, Equus caballus
SQGSVTFGDVAIDFSREEWEWLQPAQRDLYRIVMLENYGHLVSLGLNVSKPDVVSLLEQGKEPWLGNGDVRRDLFSVSESN

SEQ ID NO: 1349 - protein, 81 aa, Equus caballus
AQESLTFDDVAVEFTWEEWQLLAPAQKDLYRDVMLENYSNLVSVGYQASKPDALSKLVQGEPPWTMEDEIHCRTHSEIWEV

SEQ ID NO: 1350 - protein, 81 aa, Physeter macrocephalus
QPQEAVTFKDVEVTFSQDEWGWLDASQRNLYRDVMLENYGNVASLVGPFTKPALISWLEAREPWGLNVQGAHPKGSPSAAP

SEQ ID NO: 1351 - protein, 81 aa, Pteropus vampyrus
EMDSVTFEDVAVNFTSEEWALLDPSQKKLYRAVMRETFRNLASIGLNLGKKWEDHNIEDRYKTHGKKLRSHMVEKLHESKE

SEQ ID NO: 1352 - protein, 81 aa, Pan paniscus
LRGLVTFEDVAVEFTQEEWALLDPAQRTLYRDVMLENCRNLASLGCRVNKPSLISQLEQDKKVITEERGILPSTCPDLETL

SEQ ID NO: 1353 - protein, 81 aa, Tursiops truncatus
MDSVTIEDVAVDFTLEEWALLGPSQRKLYRDVMQETLRNLAAVGAKREYHAIEDQYKNQGRKLRTFMVERFCKSKDISLCG

SEQ ID NO: 1354 - protein, 81 aa, Sarcophilus harrisii
ALESVTFQDVAVNFTHEEWGHLKPAQKDLYREVMMENYQNFVSLGLPFSKPHVISQLEKGEAPWITEKASLVPRVSCQDFF

SEQ ID NO: 1355 - protein, 81 aa, Callorhinus ursinus
PQESVTFKDIAVDFTQEEWALLDTSQRKLYRDVMLENISHLVSVGYHLCKSDVISQLEQGVELWREGRGFPQGPNPDRKSG

SEQ ID NO: 1356 - protein, 81 aa, Aotus trivirgatus
ESVAFEDVAVYFTQNQWASLDPAQRALYREVMLENYANVASLVAFPFPKPALISHLEKGEAPWGPDPWDAEIPSSLSQGDE

SEQ ID NO: 1357 - protein, 81 aa, Monodelphis domestica
FQESVTFRDVAVDFTQEEWRHLEPAQRALYRDVMLENYENLVSVGIPVSRLDVTSLLERQEAVWKDGGLRDSCLDSLSNKI

SEQ ID NO: 1358 - protein, 81 aa, Monodelphis domestica
SQELVTFEDVAIYFTEEEWGLLDPAQRKLYRDVMLENFGNVLLLGFPVSKPDIISKLERGEIPCVPFLPRKKILVIRLGGG

SEQ ID NO: 1359 - protein, 81 aa, Monodelphis domestica
SQEVVTFQDVAVNFTREEWRLLSPPQKELYREVMLENARNLLSVGLPASIEDVISNVEQREALWMLEREGLRSCCPEEDIR

SEQ ID NO: 1360 - protein, 81 aa, Trichechus manatus
AQEFVMFRDVAVFFSQEEWGHLDPAQRALYREVMLENYSNLVSLGIRFSKPKVISQLQQGEDPWMVDRGVPQGACQGWKSL

SEQ ID NO: 1361 - protein, 81 aa, Equus caballus
FQGSVMFSDVSIDFSQEEWEYLDLEQRALYRDVMLENYSNLVSLGCFISKPDVISLLEQGKEPWKVVRKGKRRYPDLETRY

SEQ ID NO: 1362 - protein, 81 aa, Equus caballus
QAELTFEDVAVFLSQEEWGRLDPAQRGLYRDVMLETYRNLVSLGAGPAGPKPGVITQLERGDEPWVLDTQGVEGRERQKVD

SEQ ID NO: 1363 - protein, 81 aa, Aotus trivirgatus
VQEPVTFKDVAVDFTQEEWGQLDLVQRTLYRDVMLETYGHLLSVGNQIAKPEVISLLEQGEEPWSVEQTCPQRSCPEWMRN

SEQ ID NO: 1364 - protein, 81 aa, Chlorocebus sabaeus
FEELVTFEDVFVDFSPEELSSLSAPQRNLYREVMLENYRNLVFLGYQFSKPDIISRLEVEESHAMETDSRHTVICQGEAHD

SEQ ID NO: 1365 - protein, 81 aa, Equus caballus
FQGSLSIEDVTVGFTQEEWQHLDPAQRTLYRDVMLENYSHLVSVGYCIPKPEVIFKLERGEQLWILEEESSSQSHPEVCKV

SEQ ID NO: 1366 - protein, 81 aa, Lipotes vexillifer
TQGLVTFRDVAIEFSQEEWKCLEPAQKDLYKDVTLENFSNLVSLGLSLPKPDVISLLEQGKEPWMVINDMTGPWCPDLESR

SEQ ID NO: 1367 - protein, 81 aa, Equus caballus
SQGLVTFEDVAVYFSLEEWERLDAAQRDLYKEVMQENYGILVSLGYPIPKPDLIFRLEQGEEPWVPDSPRPEEGDIVTGVY

SEQ ID NO: 1368 - protein, 81 aa, Suricata suricatta
AHHLVMFRDVAVDFSQDEWECLNSYQRNLYRDVILENYSNLVSVAGCSISKPDVITLLEQGREPWMVVRDERRRRTLDLES

SEQ ID NO: 1369 - protein, 81 aa, Callorhinus ursinus
AHHLVMFRDVAVDFSKEEWECLNSYQRNLYRDVILENYSNLVSVGCSISKPDVITLLEQGKEPWMVVRDERRRRSLDLESR

SEQ ID NO: 1370 - protein, 81 aa, Trichechus manatus
LQEAVTFKDVAVVFTEEELGLLDSTQRTLYRDVMLENFRNLVSLGHQSFKPDVISQLEREEKLWLKKLQTQRGRRSGGRSQ

SEQ ID NO: 1371 - protein, 81 aa, Equus caballus
PHRLVLFRDVAVDFSQEEWACLDSEQKDLYRDVMLENYSNLVSLGFSSSKADMLSLLEQGKEPWKVVQDVARSQSSDLGSR

SEQ ID NO: 1372 - protein, 81 aa, Suricata suricatta
PQKSVTFEDVAVYFTQTEWDGLSPAQRALYRDVMLENYGNVASLGFSLLKPAVILQLEGAGELGDPSLLVAGTEVGSQGVW

SEQ ID NO: 1373 - protein, 81 aa, Sarcophilus harrisii
VPALVTFRDVAVDFTQEEWRHLEPAQRALHRDVMLENFQNLVSVGLPVSKVDVISLLERGEAPWQPEGGGPPDPCYDYLNW

SEQ ID NO: 1374 - protein, 81 aa, Lipotes vexillifer
MAFKDVAVAFTQKEWKLLSPAQRTLYRDVMLENYSHMVSLGIAFPKPKLIIQLEQGDEPWREESESLLDLCPEPRTEFQPH

SEQ ID NO: 1375 - protein, 81 aa, Tursiops truncatus
AHGSVMFSDVSIDFSQEEWDYLDLEQRDLYRDVMLENYSNLVSLGCFVSKPDVIFLLEQGKEPWKVVRKGRRRYPDLETNY

SEQ ID NO: 1376 - protein, 81 aa, Trichechus manatus
PQGSVTFEDVAVDFSQEEWELLDPAQRTLYREVMLETCRNLVSLGCSLCQPVAPPHLEQGEAVWMVDRGIPQAFCSDWETR

SEQ ID NO: 1377 - protein, 81 aa, Sarcophilus harrisii
FHQLVTFEDVAVYLSKEEWKRLNLAQRELYRDVMLENYENLLSLGFPVSKPDIISQLEQRKEAWIVQGPEKRKFSQNAHRD

SEQ ID NO: 1378 - protein, 81 aa, Pteropus vampyrus
LLTFEDVAISFSEEEWKLMDPAQKMLYSDVMQENYETVISLGLKLKKDTGNDQPISTSTLEIQASGCKVLRKARMKVAQKT

SEQ ID NO: 1379 - protein, 81 aa, Trichechus manatus
QAAVTFEDVAVLLSREEWCRLAPAQRDLYRDVMLETYRNLISLGTGLTGPKPGVISQLERGHEPWVLDVQSTKGRVDGSDC

SEQ ID NO: 1380 - protein, 81 aa, Lipotes vexillifer
LQVSVSFEDVAVDFSREEWQQLDSTQRRLYQDVMLENYSHLLSLGCEIPKPEVIFKLEQGEEPWTLEEETPHQSCSDEKFG

SEQ ID NO: 1381 - protein, 81 aa, Trichechus manatus
FQESVTFEDVAVYFTQSQWASLGPLQRALYREVMLENYANVASLAFPFPKPVLISQLEREEAPLGPDPWETEVLRDICPGG

SEQ ID NO: 1382 - protein, 81 aa, Trichechus manatus
TQVSLTFDDVAVKLTWEEWQLLDPAQKDLYRDVMLENYSNLVSVGYQVSKPDALSRLERGEPPWSIEDKIHTRTFSGERPY

SEQ ID NO: 1383 - protein, 81 aa, Pan paniscus
MMTFRDVAIDFSQEEWKWLQPAQRDLYRCVMLENYGHLVSLGLSISKPDVVSLLEQGKEPWLGKKGISESSGEIKDFSPKN

SEQ ID NO: 1384 - protein, 81 aa, Lipotes vexillifer
ELVTFRDVVISFSQEEWEYLDSAQRDLYWDVMMENYSNLVSLDLESKYDKKTLSTEKDIIEKNDSQWEVIESSKLVGLANS

SEQ ID NO: 1385 - protein, 81 aa, Pteropus vampyrus
KPEDVSFAEVAVYFSLDEWGYLWPAQRALYRDVMRETYGHFGELGFPGPKPALISWMEQESEAWSPAAQDPEEGESVGGAV

SEQ ID NO: 1386 - protein, 81 aa, Pteropus vampyrus
SQSLVTFGDVAVDFSQEEWERLSSDQRDLYRRVMLENYRNLVSLGLCFSKPDIISSLEQRKELWMAKREVTRGQCPDWKAV

SEQ ID NO: 1387 - protein, 81 aa, Trichechus manatus
KTQVSLEFNDVAVEFAWEEWQLLDPAQKDLYREVMLENFHNLVSVGCQVGKPDVLFRLEREPPWSLEDEIHSQNFSEIQEV

SEQ ID NO: 1388 - protein, 81 aa, Sarcophilus harrisii
HQDLVTFKDVAVDFTPEEWGQLVPSQKELYRDVMLENYQNLVWLGLAVSKPDVIYQLEQVGGTWVPEGETLTVSCSDFVTR

SEQ ID NO: 1389 - protein, 81 aa, Monodelphis domestica
AQEVVSFKDVAVDFTREEWRLLSPPQKELYKEVMLENARNLLSVGLSAPPEDMFSSLEQREAPWMLEKDDLRSCCPEGKMR

SEQ ID NO: 1390 - protein, 81 aa, Tursiops truncatus
QPQEAVTFKDVEVTFSQDEWGWLDASQRNLYRDVMLENYGNVTSLVGPFTKPALISWLEAREPWGLNVQGAHPKRSPSAAP

SEQ ID NO: 1391 - protein, 81 aa, Aotus trivirgatus
AIRSVMFSDISIDFSPEEWEYLDLEQKDLYRDVMLENYSNLVSLGCFISKPDVISLLEQGKEPWKVVRKRRRQYPEMLLLL

SEQ ID NO: 1392 - protein, 81 aa, Tursiops truncatus
PQGCAISEDVFVYFSREEWVLLDEDQRLLYRDVMLENFALLASLGITSSRSYLVTQLEQGEEPWMPAQVDMTAATEKEAQK

SEQ ID NO: 1393 - protein, 81 aa, Tursiops truncatus
PQDLVTFKDVAIDFSQEEWEWLNPAQRSLYRSMMLENYQSLVSVGLCVSKPYVISLLEQGKEPWEMKSEMRRTPFPDWESV

SEQ ID NO: 1394 - protein, 81 aa, Pteropus vampyrus
TQESVTFRDVAVHFSRDEWLYLDPAQRALYREVMLENYSSLVSLGILFSKPKVIFQLQQGEDPWMVENGVSCGACLGWESL

SEQ ID NO: 1395 - protein, 81 aa, Aotus trivirgatus
EPGAVTFGDVAVYFSREEWGCLRPAQRALYRDVTRETYSHLGALGVGGSKPALISWMEEEAELWGPAAQDPEVAKCPTEAD

SEQ ID NO: 1396 - protein, 81 aa, Aotus trivirgatus
SQEPVTFADVAVVFTPEEWVFLDSTQRSLYRDVMLENYRNLASVAGDQLCKPNALSYLEQRGEQWTTERGVISDTCPEPQL

SEQ ID NO: 1397 - protein, 81 aa, Callorhinus ursinus
FQGSVTFRDVAIDFSQEEWEWLQPAQRDLYRHVMLENYGHLVSLAGFNISKPYVVSLLEQGREPWLVKGDVRRDPFSESNG

SEQ ID NO: 1398 - protein, 81 aa, Monodelphis domestica
AQEVVTFKDVAVDFTREEWCLLSPPQKELYKEVMLENAQNLLSVGLPGPPEDVISYLKQRKDPWMLEQEGLRSCCPEGEIR

SEQ ID NO: 1399 - protein, 81 aa, Monodelphis domestica
VQVPIKFEDVAVYFSEPEWKNLDQWQKELYKHVMTANYEILFSLDSAIPKPDLISHIERGEEPFLRDHGNLMKRDKTIGYG

SEQ ID NO: 1400 - protein, 81 aa, Monodelphis domestica
SQGPVKFEDVAIYLWKEEWELMDSTQKRLYRQVMLETYENVLSVGTPHDKPAMIVHLEQGETAWSPALQRPGKEKGRLHGH

SEQ ID NO: 1401 - protein, 81 aa, Monodelphis domestica
SQKALTFQDVAVEFTQEEWGLLEPAQKNMHRDVMLENYENFVSLGLPVPKSALIFHLERRETPWLPSGEVLRNTYPDYLVQ

SEQ ID NO: 1402 - protein, 81 aa, Papio anubis
SQESVAFEDVAVYFTTKEWAIMVPAERALYRDVMLENYEAVAFVVPPTSKPALVSHLEQGKESCFIRPQVVLSRSDWRAGL

SEQ ID NO: 1403 - protein, 81 aa, Aotus trivirgatus
RPRALKFVDVAVYFSSEEWGCLRPAQRALYRDVMRETYGHLGALGFPGPKPALISWMEQESEAWSSAAQDPEKGENLGGAR

SEQ ID NO: 1404 - protein, 81 aa, Aotus trivirgatus
TQESLTLEDVAVEFSWEEWQLLDTAQKDLYRDVMVENYNHLVSLGYQTSKPDALSKLAHGQEPWMTDAKIQNKNCPGIRKV

SEQ ID NO: 1405 - protein, 81 aa, Callorhinus ursinus
CEGLVSFEDVTMDFSREEWQQLDPAQRCLYWDVMLEIYSHLLSVGYHIPNPEIISRMEKGKKSWIRGAQLPHQRHREVVFG

SEQ ID NO: 1406 - protein, 81 aa, Aotus trivirgatus
SKGSLMFRDVSIDFSQEEWECLDSGQMNLYKEVMLENFSNLVSVGLSSSKPAVISLLEQGREPWMVDRELTRGLCSDLESM

SEQ ID NO: 1407 - protein, 81 aa, Lipotes vexillifer
KEAFMAFGDVAVDFTQEEWRLLSPAQRTLHREVMLETYNHLVSLEIPFSKPKLISQLERGEEPWIKERQRPLSLCPAGSKL

SEQ ID NO: 1408 - protein, 81 aa, Callorhinus ursinus
SQEPVTFEDVAVYFTQNQWASLDPMQRALYLEVMLENYANITSLAALPFPKPDLILQLEQGEAPWGLDPWTPLDGEALGGV

SEQ ID NO: 1409 - protein, 81 aa, Tursiops truncatus
VQASLSFEDVAVHFTWEEWQLLDPSQKDLYRNVMWENYCNLVSVGYQTPKPDSFFQLEQGEPPWTVEGAGQSQTCPGTRAS

SEQ ID NO: 1410 - protein, 81 aa, Papio anubis
VQEPVTFKDVAVDFTQEEWGQLDLVQRTLYRDVMLETYGHLLSVGNQIAKPEVISLLEQGEEPWSVEQACPQRACPEWMRN

SEQ ID NO: 1411 - protein, 81 aa, Nomascus leucogenys
FQASVSFQDVTVEFSQEEWQHLGPVERTLYRDVMLENYSHLVSVGYCFTKPELIFTLEQGEDPWLLEKEKGFLSRNSPEDS

SEQ ID NO: 1412 - protein, 81 aa, Homo sapiens
PQKSVTFEDVAVYFTQAEWDGLSPAQRTLYRDVMLENYGNVASLGFPLLKPAVISQLEGGSELGGSSPLAAGTGLQGLQTV

SEQ ID NO: 1413 - protein, 81 aa, Ursus arctos
AHHLVMFRDVAVDFSQEEWECLNPYQRNLYRDVILENYSNLVSVGCSISKPDVITLLEQGKEPWMVVRDERRRSLDLESRY

SEQ ID NO: 1414 - protein, 81 aa, Saimiri boliviensis
KPGALSFADVAVYFSPEEWGCLRPAQRALYRDVMRETYGHLGALGFPGPKPALISWMEQESEAWSSAAQDPEKGESLGGAR

SEQ ID NO: 1415 - protein, 81 aa, Balaenoptera acutorostrata
TQVSVTFDDVAVTFTREEWRQLDPAQRTLYQEVMLENCRLLVSLGCPVPRPELIFQLEQGQKLWTVKEDLSRSTCPGKRYR

SEQ ID NO: 1416 - protein, 81 aa, Propithecus coquereli
GSVMFSDVSVDFSQDEWECLDPVQRDLYREVMLENYSNLVSVGLYIPKPQVISLLEQGKEPWMVGKELTRGLCSDLESMCE

SEQ ID NO: 1417 - protein, 81 aa, Propithecus coquereli
ESVTFEDVAVYFSENEWIGLGPAQRALYRDVMLENYGAVASLAFPFPKPALISQLERGEAPWCSAPQGALDGESPRGISSE

SEQ ID NO: 1418 - protein, 81 aa, Panthera pardus
SYGSLSFEDVTVGFSQEEWQHLDPAQRTLYRDVMLENYSHLVAVGCCVPKPDVIFRLEQGQQPWIVEEESLDQSCPEVCKV

SEQ ID NO: 1419 - protein, 81 aa, Panthera pardus
FQASVVFEDVAVNFTPEEWALLNRGQRKLYRDVMLETCRNLSAVEKQKFHSSGDLTRMQEGLLRSPLVESVCERIEGDPCG

SEQ ID NO: 1420 - protein, 81 aa, Ursus maritimus
SQEPVTFEDVAVYFTQNQWASLDPTQRALYREVMLENYANITSLAAFPFPKPDLILQLERGEARWGLDPWIAIEGEALGGV

SEQ ID NO: 1421 - protein, 81 aa, Ursus americanus
RPRAVKFADVAVYFSPEEWGCLRPAQRALYRDVMRETYGHLGALGFPGPKPALISWMEQESEAWSPDAQDPEEGESLGGAL

SEQ ID NO: 1422 - protein, 81 aa, Propithecus coquereli
MTFEDVTVEFTPWEWGQLDPAQKDLYREVMLENFRNLASLGLPVSKPHVICQLEEGEEPCVLEREISVGAQSDLKRRPKAK

SEQ ID NO: 1423 - protein, 81 aa, Saimiri boliviensis
SQGSVSFKDVTVDFTQEEWQQLDPAQKALYRDVMLENYCHFIAVGFHMTKPDMIRKLEQGEELWTQRIFPSYSYLEEDGKT

SEQ ID NO: 1424 - protein, 81 aa, Vombatus ursinus
FQGSVTFQDVAVVFTPEEWGHLEPSQKELYREVMLENFRNLVCLGLVVYKPSVIYQLERGGAPWKPGGGGRRSGSSDWETL

SEQ ID NO: 1425 - protein, 81 aa, Cervus elaphus
MAFEDVAVHFSQEEWGLLDTAQRSLYRRVMLENFALLASLGLSVSRPHVVTQLERGEEPWVLSGVDVTLPRDAQRRPHRGS

SEQ ID NO: 1426 - protein, 81 aa, Colobus angolensis
KPGTVSFADVAVYFSREEWGYLRPAQRALYRDVMRETYCHLGALGVGGSKPALISWVEEEAELWDPAARDPEVTKGLTETD

SEQ ID NO: 1427 - protein, 81 aa, Tupaia chinensis
VQGSVTFRDVAVLFSQDEWLHLDTAQRTLYREVMLENYSNLVSLGILFSKPKVISQLEQGQDPWKVEHGAPQGTCPGWESL

SEQ ID NO: 1428 - protein, 81 aa, Ursus arctos
PQVLVSFEDVAVFLSREEWGCLGPAQRGLYRDVMLETYRNLISLGFQDSKPDVISKLEEGEEPWAPYSPRIEEGWIQSHGS

SEQ ID NO: 1429 - protein, 81 aa, Muntiacus reevesi
PQEPVTFADVAVLFTPEEWLFLDSAQKSLYRDVMLENYRNLASVGDQLCKTKMSSHMEQREELCVTERGVFPGAHLGPHLQ

SEQ ID NO: 1430 - protein, 81 aa, Muntiacus reevesi
KPLAVRFADVAVYFSPEEWGCLLPAQRALYRDVMRETYGHLGALGFPGPKPALISWMEQESEAWSPDAQDPEEGESLGGAL

SEQ ID NO: 1431 - protein, 81 aa, Lynx pardinus
AQAPLSFEDVAVSFSREEWRLLVPAQKDLYRDVMLENYRNLVSVGYQASEPDSLFQLEHGGPLWAVEGAAPRPPCPGFVLQ

SEQ ID NO: 1432 - protein, 81 aa, Saimiri boliviensis
PQESVAFDDVAVYFTKKEWAIMVPDQRALYRDVMLENYEAVAFVVPPTSKPALVSHLEQGKEPCFTQPQGVLSRSNWRAGF

SEQ ID NO: 1433 - protein, 81 aa, Cervus elaphus
RTSAFPFQAPVTFGDLAIYFSQEEWEWLSPIQKDLYEDVMLENYQNLVSLGLCFRRPNVITLLEKGKAPWMVDPVKRRRGL

SEQ ID NO: 1434 - protein, 81 aa, Cervus elaphus
SEGLVTFGDVAVDFSQEEWEWLNPAQRSLYRKVMLDNYRSLVSLGVSVSKPDVISLLEQGKEPWLVKEEGPRGARSDWEYA

SEQ ID NO: 1435 - protein, 81 aa, Cervus elaphus
TSEPVSFADVAVYFSQEEWGCLQPAQRALYRDVMRETYGHLGALGFRGTKPALISWVEEEAELWGPDAGPPEMGECLTEAD

SEQ ID NO: 1436 - protein, 81 aa, Colobus angolensis
AQMLVTFKDVAVTFTQEEWRQLDLTQRTLYREVMLETCGLLVSLGHRVPKPELVHLLEHGQELWTVKTGLSQPTCAGDRTQ

SEQ ID NO: 1437 - protein, 81 aa, Saimiri boliviensis
IQRLLTFGDVAVAFTRIEWRHLDAAQRALYRDVMLENYGNLVSVGLLSSKPKLIAQLEQGAEPWMEARETPSGTRAVPDYW

SEQ ID NO: 1438 - protein, 81 aa, Saimiri boliviensis
MDLVMFRDVAVDFSQEEWECLNSYQRNLYRDVILENYSNLVSLAGCSISKPDVITLLEQGKEPWLVVRNEKRRWSLDLESR

SEQ ID NO: 1439 - protein, 81 aa, Vombatus ursinus
FQESVMFEDVAVYFTQKEWADLAPAQRALYRDVMLENYGNMVSLAFPFPKPAVISKLERGEEPWGLDPQVVPNEEGLKGFP

SEQ ID NO: 1440 - protein, 81 aa, Balaenoptera acutorostrata
MDSVTIEDVAVDFTLEEWALLDPSQRKLYRDVMQETLRNLAAVGAKREYHDIEDQYKNQGRKLRTFMVERFCKSKDISLCG

SEQ ID NO: 1441 - protein, 81 aa, Mustela putorius
SKVPVTFGDLAIYFSQEEWEWLSPIQKDLYEDVMLENYQNLVSVGLSFRRPNVITLLEKGRAPWMVEPVRKRRGMDSGSKC

SEQ ID NO: 1442 - protein, 81 aa, Propithecus coquereli
ESLTLEDVAVEFTWEEWQLLGPAQKDLYWDVMLENYNHLVSLGYQASKPDALSKLAQGEEPCVIEGKIQNRNCPGIRKADS

SEQ ID NO: 1443 - protein, 81 aa, Mustela putorius
LQGLLTFRDVAIEFSEEEWGCLTHTQRQLYRDVMLENYGHLHFLGLLLSKPDLIMFLEQEKQLWDVKRKESRGFSPESQCL

SEQ ID NO: 1444 - protein, 81 aa, Camelus ferus
GSVCEVSVSFEDVTVDFSREEWQHLDPAQRRLYWDVTLENYSHLCSVGYQVPKPEVIFKLEQGEGPWTLEEETPHQSCSGA

SEQ ID NO: 1445 - protein, 81 aa, Vicugna pacos
SQGLVTFGDVAVDFSQEEWEWLDCAQRTLYRSVMLENYRSLVSLGLCVSKPEMISSLEQRKEPWTVKRKWTRGQCPDSEAV

SEQ ID NO: 1446 - protein, 81 aa, Colobus angolensis
SLTLEDVAVDFTWEEWQLLGPAQKDLYRDVMLENYSNLVAVGYQASKPDALSKLEQGEEPCTTEDEIYTRICCGGQPQTCS

SEQ ID NO: 1447 - protein, 81 aa, Odobenus rosmarus
SKVPVTFGDLAIYFSQEEWEWLSPIQKDLYEDVMLENYQNLVSLGLSFRRPNVITLLEKGKAPWIVEPVRKRRGVDSGSKS

SEQ ID NO: 1448 - protein, 81 aa, Ursus americanus
QAEVTFEDVAVLFSREEWGRLGPAQRGLYRDVMLETYRNLVSLGAGPAAPKPGVITQLERGDEPWVLDAQGAKGKERLRVS

SEQ ID NO: 1449 - protein, 81 aa, Vombatus ursinus
TQESVMFEDVAVDFTREEWSHLDPAQRALYREVMLENYENLVSLGLPVSKLDVISLLERGEAPWRPEGGGPRCSCPDPFIE

SEQ ID NO: 1450 - protein, 81 aa, Vombatus ursinus
FQESVTFQDVAVDFTWEEWGHLGPAQKELYREVMLENYRNLVCLGLEVSKPDVVCQLERGEAPWMPEGAVPRSCSQNWGAR

SEQ ID NO: 1451 - protein, 81 aa, Vicugna pacos
RPESVTFEDVAIYFSENEWTGLAPAQRALYRDVMLENYGALASLAFPFPKPALIFQLEQGEAPWSSAPQGALDGEGPRGIS

SEQ ID NO: 1452 - protein, 81 aa, Delphinapterus leucas
MDSVTIEDVAVDFTLEEWALLGPSQRKLYRDVMQETLRNLAAVGAKREYHDIEDQYKNQGRKLRTFMVERLCKSKDISLCG

SEQ ID NO: 1453 - protein, 81 aa, Tupaia chinensis
QPGAVRFADVAVYFSPEEWGCLRPVQRALYRDVMRETYSHLVALGVGGTKPKLISWVEEEAELWGPEAQDLEGAKCLTEAN

SEQ ID NO: 1454 - protein, 81 aa, Colobus angolensis
CWGLLSFKDISMEFTWDEWQLLDSTQKYLYRDVILENYHNLISVGYHGTKPDLIFKLEQGEDPWIINAKISRQSRPDGWEE

SEQ ID NO: 1455 - protein, 81 aa, Mustela putorius
FQEAVTFNDVAVVFSEEELGLLDSTQRKLYRDVMLENFRNLVSLGHSSSKPDMISQLEREEEKLCMKEIRTERGGRNPNEA

SEQ ID NO: 1456 - protein, 81 aa, Gulo gulo
SQDLVTFKDVAIDFSQEEWEWLNPAQRNLYKNMMLENYQNLVSLGLCISKPYVISLLEQGKGPWEMKTEMTRSPFPDSGSV

SEQ ID NO: 1457 - protein, 81 aa, Erinaceus europaeus
SLGMVSFEDVAVTFSREEWQQLDEAQRTLYREVMLEAYSNLKTVGCCWSKPEVIIRLEQGVEPWTVEGVTNQRFSDVLTVD

SEQ ID NO: 1458 - protein, 81 aa, Carlito syrichta
LQELLSFEDLSVDFTQKEWQLLNPYQKNLYKDVMLENYSSLVSLGYEVIKPDVIFKLEQGEEPWIRDAEMPSSPSLEVWQV

SEQ ID NO: 1459 - protein, 81 aa, Carlito syrichta
FQELVTFRDVAIDFSRQEWEYLDPNQRDLYRDVMLENYSNLVSLGHSISKPDVVDLLEQGKEPWMLLGEETQYSGSNPEPV

SEQ ID NO: 1460 - protein, 81 aa, Carlito syrichta
AHDLVVFRDVSVDFSQEEWECLNSYQRNLYRDVILENYSNLVSLGCSISKPDVITLLEQGKEPWMVVRNEKRRWNLDLESK

SEQ ID NO: 1461 - protein, 81 aa, Vicugna pacos
YQRPVSFKDVVVGFTQEEWHRLNPAQRALYRDVMLETYSNLVSVGYEGTKPYVILRLEQEEAPWICEAACPGCHCRENIWQ

SEQ ID NO: 1462 - protein, 81 aa, Odobenus rosmarus
PQEPVTFEDVAVYFTQNQWASLDPTQRALYREVMLENYASVASLVAFPFPKPDLVSQLERGEAPWSPDPWEAEVLKGTCPG

SEQ ID NO: 1463 - protein, 81 aa, Gulo gulo
FQEAVTFKDVAVVFSEEELGLLDPAQRKLYRDVMLENFRNLVSVGHSSSKPDMISQLEREEKLCVKEIHTERGGRNPNEAE

SEQ ID NO: 1464 - protein, 81 aa, Carlito syrichta
MAFMDVAVDFTQEEWRLLSPAQRTLYREVMLENYSNLVSLGIPFSKPKLITLLEQEKVTWREKRKCPLATCPAEPEPEPEL

SEQ ID NO: 1465 - protein, 81 aa, Carlito syrichta
GKALLSFEDVAMYFTREEWNHLDWAQKDLYRDVMLENYMNMVLLGFQFPKPEVICQLENWDEPWILDLPRAGNRKASSSAC

SEQ ID NO: 1466 - protein, 81 aa, Vicugna pacos
MFQVTFSDVAIDFSHEEWGWLDSAQRDLYKDVMVQNYENLVSLGLSIPKPNVIALLEEGKDPWMVERKLSTGMFPDWDSRW

SEQ ID NO: 1467 - protein, 81 aa, Odobenus rosmarus
SQSLVTFGDVAVDFSQEEWEWLNSAQRNLYRSVMLENYRNLVSLGLCVSKPDVISSLEQRKEPWMVKRKLTRGRCPDLKTV

SEQ ID NO: 1468 - protein, 81 aa, Mustela putorius
QAEVTFEDVAVLFSREEWGRLGPAQRGLYRDVMLETYRNLVSLGAGPAGPKPGVITQLERGDEPWVLDAQGAEGKERLRVS

SEQ ID NO: 1469 - protein, 81 aa, Mustela putorius
IQEPVTFKDVAVDFTQEEWGQLDSVQRTLYRDVMLETYGHLLSVGNHIAKPEVISLLEQGEEPWSVEQAYPQSTCPEWMRN

SEQ ID NO: 1470 - protein, 81 aa, Tupaia chinensis
EQVTFKDVAIEFSKTEWKRLDPAQRALYREVMLENYRNLVSVGTSPPDVTVISMLEQGEEPWTAESRVQRPEVPGGREWTQ

SEQ ID NO: 1471 - protein, 81 aa, Odobenus rosmarus
SSQELLTFRDVAIEFSQEEWRCLNHTQRELYRDVMLENYGHLLFLGLIVSKPDLVSFLEQTKDPWDGKSKKTVAFHPGRWE

SEQ ID NO: 1472 - protein, 81 aa, Colobus angolensis
YQTPVSFKDVVVGFTQEEWHWLSPAQRALYRDVMLETYSNLVSVGYEGTKPDVILRLEQEEAPWIGEAACPGCHCWGISKL

SEQ ID NO: 1473 - protein, 81 aa, Gulo gulo
QGSVTFRDVAIDFSQEEWEWLQPAQRDLYRHVMLENYGHLVSLGLNISKPYVVSLLEQGRDPWLEKDVRRDLFSESSGEIR

SEQ ID NO: 1474 - protein, 81 aa, Erinaceus europaeus
KPAAVRFADVAVYFSPEEWGCLRPAQRTLYRDVMRETYGHLGALGFPGPKPALISWMEQESEVWSPAAQDPEEGESLGGAR

SEQ ID NO: 1475 - protein, 81 aa, Erinaceus europaeus
SKAPVTFGDLAVYFTQAEWEWLSPVQKALYQDVMLENYQVLVSLGLCLRRPNLISLLEKGKAPWVAEPVRRRRGPDSASKF

SEQ ID NO: 1476 - protein, 81 aa, Odobenus rosmarus
ARGLVTFEDVAVYFSREEWGLLNLTQRSLYRDVMLENFALIGSLGFAPSRSHVVAQLESEEELWVPSMVDLTLGSRAEARR

SEQ ID NO: 1477 - protein, 81 aa, Vicugna pacos
MFQVTFSDVAIDFSHEEWGWLDSAQRDLYKDVMVQNYENLVSLGLSIPKPNVIALLEEGKDPWMVERKLSTDWDSRWENKE

SEQ ID NO: 1478 - protein, 81 aa, Carlito syrichta
VSFEDVAVYFTQEEWTLLDSAQRDLYRDVMLETCENLASIGNLLNHSVMYWLEGEENLGTVQEGDPQEWRLKTKGSTLRPD

SEQ ID NO: 1479 - protein, 81 aa, Delphinapterus leucas
QPQEAVTFKDVEVTFSQDEWGWLDASQRNLYRDVMLENYGNVTSLVGPFTKPALISWLEAREPWGLNVQGAHPKGSPSAAP

SEQ ID NO: 1480 - protein, 81 aa, Carlito syrichta
MTFSDVAVDFSQQEWECLDPVQKTLYRDVMMENYGNLVSLGHSISKPDVIALLEQGKEPWVVTKEETRRCCTDLESRYEII

SEQ ID NO: 1481 - protein, 81 aa, Tupaia chinensis
MAFEDVAVYFSREEWELLDTAQRALYRHVMLENFALVASLGFSPSRPCVVIQLESGKEPWLHSGMDTTMSRHAHKRPSSGS

SEQ ID NO: 1482 - protein, 81 aa, Vicugna pacos
AHGSVMFSDVSIVFSQEEWEYLDLKQRDLYRDVMLENYSNLVSLGCFISKPDVISLLEQGKEPWKVMRKGRGRYPDLETRY

SEQ ID NO: 1483 - protein, 81 aa, Carlito syrichta
AHRSVMFNDVSIDFSREEWEYLNLEQRDLYRDVMLENYSNLVSLGYFISKPDVISLLEQGEEPWKVVRKGRRRYPDLKTNY

SEQ ID NO: 1484 - protein, 81 aa, Gulo gulo
AQELVTFKDIAIDFTQEEWALLDTSQRQLYRDVMLENISHLVSVGYHLCKSDVISQLEQGVELWRDGREFLQGLNPDRKSG

SEQ ID NO: 1485 - protein, 81 aa, Carlito syrichta
AHDLVVFRDVSVDFSQEEWECLNSYQRNLYRDVILENYSNLVSLAGCSISKPDVITLLEQGKEPWMVVRNEKRRWNLDLES

SEQ ID NO: 1486 - protein, 81 aa, Colobus angolensis
EMGLLTFRDIAIEFSLAEWQCLDHAQRNLYRDVMLENYRNLVSLGVAVSKPDLITCLEHNKEPRNIKRNEMVSKHPVTCSH

SEQ ID NO: 1487 - protein, 81 aa, Myotis brandtii
MVFEDVAVYFSREEWGLLDSAQRALYRQVMLENFALVASLGLSASRPRIILQLERGEEPWVLSGLDVALARDAQRRPSPAQ

SEQ ID NO: 1488 - protein, 81 aa, Odobenus rosmarus
AWAPLSFEDVAVGFSWEEWQLLAPSQKDLYRDVMLENYRNLVSVGYQASKPDSVFQLEQGEPPWIVEGAAQSQTCQEEIWE

SEQ ID NO: 1489 - protein, 81 aa, Colobus angolensis
SQGRVTFEDVTVNFTKGEWQRLNPEQRNLYRDVMLENYSNLVSVGREETTKPNVILRLEQGKEPWLVEEEVLGSGRPEKNG

SEQ ID NO: 1490 - protein, 81 aa, Odobenus rosmarus
MPVTFEDVAVTFTQEEWGQLDPAQRTLYQEVMLETCGLLVSLGCPLPKPELFYPLDHSPELHTLKRGLSPNSCPGDSTKPG

SEQ ID NO: 1491 - protein, 81 aa, Gulo gulo
SQSLVTFGDVAVDFSREEWEWLSSAQRNLYRTVMLENYRNLVSLGLCISKPEMISSLEQRKEPWMAKRRLTRGRCPDLKIV

SEQ ID NO: 1492 - protein, 81 aa, Erinaceus europaeus
SLGMVSFDDVMVTFSLEEWQLLSTSQRTLYRTVMLDTYSSLAALGHCAVKPGVIIKLEQGAEPWMGAQAPPRSLSDPCGPS

SEQ ID NO: 1493 - protein, 81 aa, Mustela putorius
RPELVTFEDVAVYFSENEWTSLAPTQRVLYRDVMLENYGAVASLAVPFPKPALISQLERGEAPWCKAPQGALDGEGPRGIS

SEQ ID NO: 1494 - protein, 81 aa, Colobus angolensis
ELVMFRDVAIDVSQEEWECLNPAQRNLYKEVMLENYSNLVSLGLSVSKPAVISSLEQGKEPWMFVREETGRWCSDLASRDE

SEQ ID NO: 1495 - protein, 81 aa, Mustela putorius
FQGSVTFRDVAIDFSQEEWEWLQPAQRDLYRHVMLENYGHLVSLGLNISKPHVVSLLEQGRDPWPDNGAVGGGLFSESKGE

SEQ ID NO: 1496 - protein, 81 aa, Mustela putorius
LQGQLTFRDVAIEFSEEEWRCLTHTQRQLYRDMMLENYRHLLFLGLIVSKPDLVSFLEQKKDPWDVKRKKTVVFDPGRWEW

SEQ ID NO: 1497 - protein, 81 aa, Odobenus rosmarus
FQGSVTFRDVAIDFSQEEWEWLQPAQRDLYRHVMLENYGHLVSLGLDISKPYVVSLLEQGREPWLVKGDVRRDPFSVSESN

SEQ ID NO: 1498 - protein, 81 aa, Gulo gulo
AHGSVMFNDVSIVFSQEEWEYLDLEQRDLYRDVMLENYSNLVSLGCFISKPDVISLLEQGKEPWKVVRKGRRQYPDLETRY

SEQ ID NO: 1499 - protein, 81 aa, Homo sapiens
AHALVTFRDVAIDFSQKEWECLDTTQRKLYRDVMLENYNNLVSLAGYSGSKPDVITLLEQGKEPCVVARDVTGRQCPGLLS

SEQ ID NO: 1500 - protein, 81 aa, Muntiacus reevesi
AQGSVMFTDVSIDFSQEEWEFLNPDQRDLYKDVMLENYSNLVSMGLYIPKPQVISLLEQGKEPWMIGRELTRGLCSALESM

SEQ ID NO: 1501 - protein, 81 aa, Balaenoptera acutorostrata
SQESVSFEDVAVYFTQNQWASLASAQRTLYREVMLENYANVTSLAAFPFPKPDLIFQLERGEAPGGLDPWTSIRREVRGVC

SEQ ID NO: 1502 - protein, 81 aa, Rhinolophus ferrumequinum
AHGSVMFSDVSVVFSQEEWDYLDVEQRDLYRDVMLENYNNLVSLGCFISKPDVISLLEQGKEPWKVVRKERRRYPDLETRH

SEQ ID NO: 1503 - protein, 81 aa, Ursus arctos
KPGAVSFADVAVYFSPEEWGCLRPAQRALYRDVMRETYGHLGALGFPGPKPALISWMEQESEAWSPDAQDPEEGESLGGAL

SEQ ID NO: 1504 - protein, 81 aa, Propithecus coquereli
FQEAVTFKDVAVAFTEEELGLLDSAQRKLYREVMLENFRNLVSVGHQSFKPEMISQLEREEKLWVKEIQTQMGRCRGGRNQ

SEQ ID NO: 1505 - protein, 81 aa, Propithecus coquereli
VQEPVTFKDVAVDFTQEEWGQLDLVQRTLYRDVMLETYGHLLSVGNQITKPEVISLLEQGEEPWSVEQAYPQSTCPEWMRN

SEQ ID NO: 1506 - protein, 81 aa, Myotis brandtii
FQESVTFEDVAVYFTQNQWASLDPVQRALYRDVMLENYANVAALVAFPAPKPDLISQLERGSAPWRPDPWEAEVLRGICPG

SEQ ID NO: 1507 - protein, 81 aa, Propithecus coquereli
YQTPVSFKDVVVGFTQEEWHRLSPAQRALYRDVMLETYSNLVSVGYEGTKPDVILRLEQEEAPWICEVACPGCHRWEDIWQ

SEQ ID NO: 1508 - protein, 81 aa, Vombatus ursinus
FWESVTFQDVAVDFTWEEWGHLGPAQKELYREVMLENYRNLVCLGLAVSKPDVICQLEQGGAPWWPEGGVPGSSCAVWDTR

SEQ ID NO: 1509 - protein, 81 aa, Propithecus coquereli
SLGSVSFKDVTVDFSREEWQQLDLAQKSLYRDVTLENYFNLISVGCQVPKPEVIFNLEQGGELCVLDGGLSCQNCSDGDIG

SEQ ID NO: 1510 - protein, 81 aa, Pteropus alecto
KQVSISFEDVTVDFSREEWQHLDPAQRCLYRDVTLENYSHLLSVGYQVPKPEIIFQLEQGEGPWMLERETPHQSCSDEDIG

SEQ ID NO: 1511 - protein, 81 aa, Muntiacus reevesi
SQSPLTFGDVAVEFSGDEWAWLDSAQRSLHRSVMLENYRNLASLGLCMSKPEMISSLEQSKEPWAVKAKSTRGRCPGLEAI

SEQ ID NO: 1512 - protein, 81 aa, Ursus arctos
VTFEDVAVYFSWEEWGLLDEAQRCLYQDVMLENLALINSLGLRHGAEDEDAPEHRVSVQAASQVGTRKAVVSPQKAHPREV

SEQ ID NO: 1513 - protein, 81 aa, Muntiacus reevesi
QAEVTFEDVAVLLSQEEWGLLGPSQKGLYREVMLETYRNLLSLGVGLADPKPEVIVQLERGDELWVLDMHGAEQPSVDGSA

SEQ ID NO: 1514 - protein, 81 aa, Propithecus coquereli
PKAPVTFGDVAIYFSKEEWECLSPNQKDLYEDVMMENYQNLASIGFSCRRPNVITLLEKGEAPWMAEPLRRRQGPDSGSKK

SEQ ID NO: 1515 - protein, 81 aa, Myotis brandtii
LDAPVTFEDVAVYFSENEWTCLTCPQRALYRDVMLENYGAVASLAFLFPKPALISRLERGEAPWCSAPQGALDGEGWKGVS

SEQ ID NO: 1516 - protein, 81 aa, Macaca nemestrina
GRVTFRDVAVEFSLAEWKCLNPVQRALYREVMLENYRNLEFVDSSLKSMMEFSSHEHSNTGEGFHTGTLERHKSYHIGDFW

SEQ ID NO: 1517 - protein, 81 aa, Propithecus coquereli
SLGSELFRDVAIVFSQEEWQWLAPAQRDLYRDVMLETYSNLVSLGLAISKPDVISFLEQGKEPWMVERVATGDLCPVLESG

SEQ ID NO: 1518 - protein, 81 aa, Propithecus coquereli
SQGLVSFKDVAVDFTQDEWQQLDPAQRTLYRDVMLENYSHLVSMGYPVSKPDVISKLEQGEDPWIIKRDISNWIYPDENQA

SEQ ID NO: 1519 - protein, 81 aa, Balaenoptera acutorostrata
LQEAVTFEDVAVNFSNEEWQCLTHAQRHLYKDVMLENYGNVVSLGFPFPKPPLISHLEQEAELCAQDRQDREFLSCSYPVS

SEQ ID NO: 1520 - protein, 81 aa, Ursus americanus
RPGAVSFADVAVYFSPEEWGCLRPAQRALYREVMRETYGHLGALGFPGPKPALISWMEQESEAWSPDAQDPEEGESLGGAL

SEQ ID NO: 1521 - protein, 81 aa, Balaenoptera acutorostrata
SQSLVTFGDVAVEFSPEEWAWLDSAQRSLYRSVMLENYRSLVSLGLCVSKPKMISSLEQRKEPWAAKRTLTRGGCPDSRAL

SEQ ID NO: 1522 - protein, 81 aa, Balaenoptera acutorostrata
KPAAVSFADVAVYFSVEEWGCLRPAQRALYRDVMRETYGHLGALGFPGPKPALISWMEQESEAWSPAAQDPEEGESLGGAL

SEQ ID NO: 1523 - protein, 81 aa, Ursus americanus
VLGLVTFGDVAIDFSREEWEWLNSAQRTLHRDVMLENYRNLVSLGLCVSKPDMISSLEQRKEPWMVKRKLTRGRCPDLKTM

SEQ ID NO: 1524 - protein, 81 aa, Saimiri boliviensis
PQKSVTFEDVAVYFTQAEWDGLSPAQRTLYRDVMLENYGNVASLGFPLLKPAVISQLEGGGELGGPSPLAAGTGLRGLWTV

SEQ ID NO: 1525 - protein, 81 aa, Balaenoptera acutorostrata
PLESVTFEDVAINFTQEEWALLDTSQRNLFRNVMLENISHLVSIGYQISKSDVISQLKQGKELRKSTVSKQCGKSLSQGSF

SEQ ID NO: 1526 - protein, 81 aa, Ursus americanus
QCGLLTFGDVAIEFSQEEWRCLSHTQRELYRDVMLENYGHLLFLGLIVSKPDLVSLLEQSKEPWDVRRKKTQRPSVLMGHV

SEQ ID NO: 1527 - protein, 81 aa, Cervus elaphus
PQDLMTFEDVAVEFTWWEWGQLDPAQKDLYREVMLENFKNLASLGFPVSKPYMICQLEEGEEPCILEREISTGVHSDWERR

SEQ ID NO: 1528 - protein, 81 aa, Colobus angolensis
TEGLVMFEDVAVYFSREEWGLLNVTQKGLYQDVMLENFALVSSLGLAPLRSPVFSQLENDEQLWVPSWVDETPVSRAEARR

SEQ ID NO: 1529 - protein, 81 aa, Cervus elaphus
TPQTLKPRAPGACSRARSPGPGIQDSDAVGSVTFEDVAVYFSWEEWALLDEAQRCLYHDVMLENFALTSSLGGPTGGGRVV

SEQ ID NO: 1530 - protein, 81 aa, Lynx pardinus
SKVPVTFGDLAIYFSQEEWEWLSPIQKDLYEDVMLENYQNLVSLGLSFRRPNVITLLEKGRAPWMVEPVRKRRVLDSRSKY

SEQ ID NO: 1531 - protein, 81 aa, Muntiacus reevesi
CNMSLSFSDVAVDLSQEEWECMSPAQRALYRDVMLENYSNLVSLGCSTPKPDMITLLEQEKEPWMILREGTGSWFTDLESE

SEQ ID NO: 1532 - protein, 81 aa, Ursus arctos
RPGAVSFADVAVYFSPEEWGCLRPAQRALYRNVMRETYGHLGALGFAGPKPALISWLERKKEVWSPEAEDPEAGARHPGSG

SEQ ID NO: 1533 - protein, 81 aa, Myotis brandtii
FQEVVTFEDVAVHFTQAEWAGLSSAQRALHRSVMLENYGNLTSLGYTVPNSALISLLEGRDLPWGLEAQNDPPAERSTHVC

SEQ ID NO: 1534 - protein, 81 aa, Vombatus ursinus
FQESVTFKDVAVDFTQEEWAQLDPPQRNLYRDVMLENYEHFVFLGLPVAKPEVISQLERGEVPLFPEQPEFSTSICPDSLN

SEQ ID NO: 1535 - protein, 81 aa, Vombatus ursinus
FQESVTFKDVAVEFTGEEWRQLDRAQRSLFRDVMLENYRNLVSLGLTVAKPNLIFLLERGEAPWTLQRQIPGGTSSDCPCW

SEQ ID NO: 1536 - protein, 81 aa, Pteropus alecto
FQASVSFKDVTVELTQEEWQQMGPLQRTLYRDVMLENYNNLVSVGSCIYKPELIFKLEQGEEPWLLEEEFSNQSYQVLEHY

SEQ ID NO: 1537 - protein, 81 aa, Nomascus leucogenys
TQEHVTFRDVAVFFSQDEWLHLDSAQRALYREVMLENYSSLVSLGIPFSMPKLIHQLQQGEDPCMVEREVSADTCLGFKTW

SEQ ID NO: 1538 - protein, 81 aa, Ailuropoda melanoleuca
EMEPHSHAVPCQPSMSFKDVAVTFTQEEWGQLNLAQRRLYRNVTLETWSHLVSLGLLLSKPDVISWLEQGQDPWRAEQGPP

SEQ ID NO: 1539 - protein, 81 aa, Phascolarctos cinereus
PQEQVTFSDVAVDFTVEEWGRLAPAQKELYRSVMLENYRNLVCLGLAASSPDVIGQLERGEGPWRVEGKVRKGLCADQKTS

SEQ ID NO: 1540 - protein, 81 aa, Ursus maritimus
ASCGLLTFRDVAIEFSQEEWRCLSHTQRELYRDVMLENYGHLLFLGLIVSKPDLVSFLELRKDPWDVKRRKTAGFDPGRWQ

SEQ ID NO: 1541 - protein, 81 aa, Muntiacus muntjak
RPRAVKFGDVALYFSREEWGCLRPAQRALYRDVMQETYGHLGALGCAGPKPALISWLERNTDDWEPAALDPQQCPKGVAVQ

SEQ ID NO: 1542 - protein, 81 aa, Oryctolagus cuniculus
KPAAVSFADVAVYFSPEEWGCLRPAQRALYREVMRETYGLLGALGGGGTKPALICWVERDAELWGPDAQDPAAAAARGYGT

SEQ ID NO: 1543 - protein, 81 aa, Oryctolagus cuniculus
SLGPVSFKDVAVGFTQEEWRQLEPAQRRTYREVMLENYSHLVAVGCHFIKPDVITKLERGEEPWIEGGFLPQGCAGDEVWQ

SEQ ID NO: 1544 - protein, 81 aa, Pteropus alecto
LFESVSFKDVTIDFSWEEWQQLDFAQKSLYRDVMLENYFNLISVGCQVPKPEVIFNLEQVENPCMLHRKISRQSCLDGDIG

SEQ ID NO: 1545 - protein, 81 aa, Ailuropoda melanoleuca
PQVLVSFEDVAVFLSREEWGCLGPAQRGLYRDVMLETYRNLISLGFQDSKPDVISKLEKGEEPWAPYSPRIEEGWIWSHGS

SEQ ID NO: 1546 - protein, 81 aa, Phascolarctos cinereus
SHESVTFKDVAVDFTWEEWGYLDTSQKELYWEVMLENYRNLVSLGLADSNVDMISQLESGEAHGIPVDSVLRSCWPDGDTR

SEQ ID NO: 1547 - protein, 81 aa, Sapajus apella
TQGQVTFRDVAIEFSQEEWTCLDPAQRSLYRDVMLENYRNLASLGISCFDLSIISMLEQRKEPFTLESQVQIAGNPDGWEW

SEQ ID NO: 1548 - protein, 81 aa, Phascolarctos cinereus
VQESVTFRDLAVDFDMEEWGYLCPSQKELYREVMLENYRHLVSLGLLEAKPDLISRLEQEEPQVWEVQEGASGSVCACTGG

SEQ ID NO: 1549 - protein, 81 aa, Phascolarctos cinereus
SQESLTFKDVAVDFTQEEWGKLDSGQRYLYRDVMLENYRNLVSLGHQGSKPYVISQLEQGQEPWIVEREISRGNCKDWGTR

SEQ ID NO: 1550 - protein, 81 aa, Canis lupus
AQGQVNFEDVAVYFSPEEWGLLDEAQRLLYRDVMLENLALMASLGYESSMSHGFASLELGSKPWGSDWADVTPARTRDTQG

SEQ ID NO: 1551 - protein, 81 aa, Puma concolor
HQISVTFDDVALDFTQEEWILLDLSQRNLYRNVMLENYQNLVTVEYQLSKPKLIAWLEQQELRAVEQGILQEWETGLQTKG

SEQ ID NO: 1552 - protein, 81 aa, Sapajus apella
DSVAFEDVAINFTCEEWALLGPSQKSLYRDVMQETIRNLDCIGMKWQNLDIEEDEYKNPGRNLRCFMVERSCEIKDNSQCG

SEQ ID NO: 1553 - protein, 81 aa, Sapajus apella
LQEPLEFMDVAIEFSLEEWHCLDTAQRNLYRDVMLENYRNLVFLGIVVSKPDLITWLEQGKKPLTVKRRGMIAAPPGMSSH

SEQ ID NO: 1554 - protein, 81 aa, Macaca nemestrina
MVSFEDVAVLLSQEEWDCLIPAQRGLYRDVMLETYGNLVSLGLQASKPDVISRLEQGDKPWTPHILRTQRSWSWRHKRECY

SEQ ID NO: 1555 - protein, 81 aa, Muntiacus reevesi
LSTQLTVEDVDIKFTPEEWECLDPAQRTLYRDVMEETYRNLLSVGIGPRLPDCSSCIHMTKKLQAKENSGKGEILQRVMCG

SEQ ID NO: 1556 - protein, 81 aa, Myotis brandtii
DKTIIAFGDVAVAFTEREWKLLSPAQRTLYRDVMLETYSHLVSLGIAFSKPKFITQLEQGDEPWREESECLLELCPEPRTE

SEQ ID NO: 1557 - protein, 81 aa, Macaca nemestrina
SQEPVTFADVAVVFTPEEWVFLDSTQRSLYRDVMLENYRNLASVADQLCKPNASSYLEQRGEQWTTDRGILADTCAEPQLQ

SEQ ID NO: 1558 - protein, 81 aa, Panthera pardus
AHRSLMFSDVSIVFSQEEWEYLDLEQRDLYRDVMLENYSNLVSLGCFISKPDVISLLEQGKEPWKVVRKGRRRYAAPMSIA

SEQ ID NO: 1559 - protein, 81 aa, Saimiri boliviensis
PQVSLTFEDVAVLFTRDEWRKLAPSQRNLYRDVMLENYRNLVSLGLPFTKPKVISLLQQGEDPWKVEKDSSGGCSPGCKSN

SEQ ID NO: 1560 - protein, 81 aa, Oryctolagus cuniculus
LPGLMAFEDVAVYFSQEEWGLLDAVQRALYRHVMLENFALVASLGLSASPPHVVIQLQRGEEPWVPSGLDMTSARNGHRRP

SEQ ID NO: 1561 - protein, 81 aa, Phascolarctos cinereus
IQELVTFKDVAVDFTQEEWGLLNNPQKELYKEVMLENAQNMLSLGLPVPREDLFSYFEEREAPWLLEQEGLRSCCAEREIR

SEQ ID NO: 1562 - protein, 81 aa, Rhinolophus ferrumequinum
DHELVTFRDVIINFSQDEWEYLNSAQRDLYWDVMMENYSNLVSLGCFISKPDVISLLEQGKEPWKVVRKERRRYPDLETRH

SEQ ID NO: 1563 - protein, 81 aa, Ursus maritimus
SQEPVTFEDVAVYFTQNQWASLDPTQRALYREVMLENYANITSLAFPFPKPDLILQLERGEARWGLDPWIAIEGEALGGVH

SEQ ID NO: 1564 - protein, 81 aa, Lynx canadensis
FQELVTFRDVAIDFSRQEWEYLDSVQRDLYRDVMLENYRNLVSLGHSISKPDVVDLLEQGKEPWMILREETQRQYTDLDLH

SEQ ID NO: 1565 - protein, 81 aa, Puma concolor
SYGSLSFEDVTVGFSQEEWQHLDPAQRTLYRDVMLENYSHLVAVGCCVPKPDVIFRLEQGQQPWLIEEESLDQSCPEVCRV

SEQ ID NO: 1566 - protein, 81 aa, Muntiacus reevesi
QAGSDLFRDVAIVFSQEEWEQLAPTQRDLYRDVMLETYSNLVSLGLAVSKPDVIAFLEQGREPWTVEGVATGGLCPVLKSR

SEQ ID NO: 1567 - protein, 80 aa, Ursus maritimus
LQGLLTFGDVAIEFSQEEWRCLSHTQRELYRDVMLENYGHLLFLGLTVSKPDLVSFLEQRKEPWDEKRNKTAGFDASRWE

SEQ ID NO: 1568 - protein, 81 aa, Panthera pardus
SSQTLLTFRDVAIEFSQEEWGCLNHSQRELYRDVMLETYGHLLFLGLVSKPDLVIVLEQKKELWGVKRKETVASHPAVSSQ

SEQ ID NO: 1569 - protein, 81 aa, Muntiacus reevesi
RKRGSLTLEDVAVDFTWEEWQLLAPAQKALYQEVMLENYGNLVFVGYQASKPAALSRLERGEPWPVEDEVHSQLCPEMRKD

SEQ ID NO: 1570 - protein, 81 aa, Muntiacus reevesi
LPLTFEDVAVYFSEQEWQNLEAWQKELYKQVMRANYEILLSLDNGLPKPELISWIEQGKELFKKWGESQQSRSIICSSADL

SEQ ID NO: 1571 - protein, 81 aa, Ursus maritimus
RPGAVSFADVAVYFSPEEWGCLRPAQRALYRDVMRETYGHLGALGFAGPKPALISWLERKKEVWSPEAEDPEAGARHPGSG

SEQ ID NO: 1572 - protein, 81 aa, Rhinopithecus bieti
PLESVTFKDVAIDFTLEEWRLMDPTQRNLHKDVMLENYRNLVSLGLAVSKPDMISHLENGKGPWVTMRGISRIPYPDIEPK

SEQ ID NO: 1573 - protein, 81 aa, Ursus arctos
AQESVMFSDVSIDFSQEEWECLNDDQRDLYRDVMLENYSHLVSMGHSVSKPDVISFLEQGKEPWLVDRELTRDHWPVLESR

SEQ ID NO: 1574 - protein, 81 aa, Pteropus alecto
LWLPLTFEDIAIYFSEQEWQNLEAWQKDLYRNVMRANYEILVSLDDGLPKPELISHIEQGKELFWNLGETQKSGNIICSSA

SEQ ID NO: 1575 - protein, 81 aa, Muntiacus reevesi
GLLSFEDVALYFTREEWDTLDWAQKALYRDVMLDNYRHIVSLGFPFPKPEVICQLEQWEEPWTLDLPRAGTRKASGSACPD

SEQ ID NO: 1576 - protein, 81 aa, Rhinopithecus bieti
PRLPLTFEDVAIYFSEQEWQDLEAWQKELYKHVMRSNYETLVSLDDGLPKPELISWIEHGGEPFRNWRESQKSRNIICSSS

SEQ ID NO: 1577 - protein, 81 aa, Panthera pardus
PRVSLTFEDVAVLFTRDEWRKLGPSERNLYQDVMLENYSNLVSLGLLFSKPKVISLLQQGEDPWKVEKESPGGPSLGYKSS

SEQ ID NO: 1578 - protein, 81 aa, Pteropus alecto
SQGLVTFEDVAVYFSLEEWQRLDAAQRDLYKEVMQENYGILVSLGYPIPKPDLIFRLEQGEEPWVPDSPSPEEGDIVTGVY

SEQ ID NO: 1579 - protein, 81 aa, Sapajus apella
FQESVAFEDVAVYFTQNQWGSLDPAQRALYSEVMLENYANVASLAFPFPKPALISHLEKGEAPWGPDPWDAEIPSGINQGG

SEQ ID NO: 1580 - protein, 81 aa, Rhinopithecus bieti
EKGPLTFRDVAIEFSLEEWQCLDTAQQDLYRRVMLENYRNLVFLGIAVSNPDLITCLEQGKEPWNMKRHAMADEPPVMYSH

SEQ ID NO: 1581 - protein, 81 aa, Puma concolor
AQAPLSFEDVAVSFSREEWRLLVPAQKDLYRDVMLENYRNLVSVGYQASEPDSLFRLEHGGPLWVVEGAAPRPPCPGEYVA

SEQ ID NO: 1582 - protein, 81 aa, Rhinolophus ferrumequinum
MLTFRDVFIEFSQEEWECLDPAQRKLYMDVMLESYRNLVSLGHSISKPDVITLLEQGKDPCMVVREETRRWCTGKNKSGRR

SEQ ID NO: 1583 - protein, 81 aa, Ursus maritimus
MFSDVSVDFSQEEWECLDPGQRDLYRDVMLENYSNLLSMGLYIPKPQVISLLEQGKEPWMVGRELTRGLCSDLESMCETKL

SEQ ID NO: 1584 - protein, 81 aa, Balaenoptera acutorostrata
AHMSLSFRDVAIDLSQEEWECLDPVQRALYRDVMLENYSNLVSLGCSSPKPDVITLLEQEREPWTVMREGTRSWYTDLESK

SEQ ID NO: 1585 - protein, 81 aa, Vombatus ursinus
FQDSVTFQDVAVTFTPEEWGRLAAPQKELYREVMLENFGHLACLGLALSKPDVICQLERGEAPWMPRGDVPQRPSAAPSGD

SEQ ID NO: 1586 - protein, 81 aa, Vombatus ursinus
FQESVTFKDVSVDFTQGEWGQLDPAQKNLYRDVMLENYRTLVSLGLQVFKPEVIYRLERGEAPWILEREISRGPCPDWPET

SEQ ID NO: 1587 - protein, 81 aa, Geotrypetes seraphini
QMRLRFEDISVSFSQEEWAYLDEEQKELYREVMRDNYQTLISLGVGFSSVTPDIISRIEQGEEPYVRDEPGSEERETGRSS

SEQ ID NO: 1588 - protein, 81 aa, Geotrypetes seraphini
ARAPVSFEEVAVYFSPEEWQTLQGWQKEMYRGVMRENYEIMLSLGYQFSKPEILLMMERGEEPCVEDCQRRIPVTFREKHL

SEQ ID NO: 1589 - protein, 81 aa, Geotrypetes seraphini
QMPVKFEDIAVSFSQEEWEYLNEEQKELYREVMEENYQTLISLGTGSPPITPDIISHIERGEEPYIREEPGSEERGPVRSS

SEQ ID NO: 1590 - protein, 81 aa, Geotrypetes seraphini
QMWVTFEDVAVSFSQEEWVYLDEGQKELYREVMKENYETVMSLAGEEFSRGKEKEGSIEQQSLKTEVHEMNKRVKLFKCSE

SEQ ID NO: 1591 - protein, 81 aa, Geotrypetes seraphini
QMQVKFEDIAISFSQEEWEYLNEEQKELYREVMEENYQTLLSLATDSPTFTPKIISYIKRGEEPYIRGEPDSEERESGKSS

SEQ ID NO: 1592 - protein, 81 aa, Geotrypetes seraphini
QMRLRFEDISVSFSQEEWAYLDEEQKELYREVMRDNYQTLISLGIGSPPVTPDIISCIEQGEEPYIRDEPGSEERKTGRSS

SEQ ID NO: 1593 - protein, 81 aa, Geotrypetes seraphini
EMRVMFEEITVSFSQEEWEYLDEGQKELYQEVMKENHETLIFLETNLQFVNPDMLSKIRRDSRMSRKRKATRSYAADDEAK

SEQ ID NO: 1594 - protein, 81 aa, Geotrypetes seraphini
QMRVTFEDISVSFSQEEWGYLNEEQKELYREVMKENYQTLISLATDSPIIDPDIISRIERGEEPYVRDEPASEERETGRSN

SEQ ID NO: 1595 - protein, 81 aa, Geotrypetes seraphini
AQMPVKFEDIAVSFSQEEWEYLNEEQKELYREVMEENYQTLISLGSPPVTPDIISHIERGEEPYIREEPGSEEREPGRSSC

SEQ ID NO: 1596 - protein, 81 aa, Geotrypetes seraphini
AQVPVTFEDIAIYFSQEEWEYLDEGQKALYREVMKENYETLLLLGCPGLKPVIISSIEQGEEPCVRKLQERAELYPTAGDE

SEQ ID NO: 1597 - protein, 81 aa, Geotrypetes seraphini
GMRVTFEDIAVSFSQEEWEYLGEGQKELYREVMKENYETLISLGTDSSALTPEIISRIERGEEPCIRDKPGSEERETGKSS

SEQ ID NO: 1598 - protein, 81 aa, Geotrypetes seraphini
ASAQVTFEDIAVSFCHEEWRYLDEGQKELYKEVMKENYETLISLGFLCEKPSLISKIEQEEDPCVRDQQNSRERRRRLKNF

SEQ ID NO: 1599 - protein, 81 aa, Geotrypetes seraphini
QMPVKFEDIAVSFSQEEWEYLNEEQKELYREVMEENYQTLISLGIGSPSVTPDIISHIEGGEEPYIREEPGSEEREPGRSS

SEQ ID NO: 1600 - protein, 81 aa, Geotrypetes seraphini
QVPVTFEDIAVYFSQEEWEDLEEQQRELYKDVMKENYETLSSLGTGPPAVTPDIISHIERGEEPYIRFESGPEEREIGKSS

SEQ ID NO: 1601 - protein, 81 aa, Pelodiscus sinensis
VVELLTFEEVAVYFSKEEWALLDPGQRALYRDVMQENYEAVSWLGFPVSKTDVISWVEREEEFWVPDPRSCEEGVIISNTH

SEQ ID NO: 1602 - protein, 81 aa, Colinus virginianus
SQEPVSFEEVAVYFSREEWALLDPAQRALYRDVMLETYECVASLAPLPAPKPMVISLLEEGEEPWIPDVGSPEAVAGDVSP

SEQ ID NO: 1603 - protein, 81 aa, Pelodiscus sinensis
VSEPVTFEEVALYFSEEEWALLDAGQRALYRDVMKENYEAVRWLDNGRLNENHDKSLQNEGPEQMAPCGMMLGISEGHVSQ

SEQ ID NO: 1604 - protein, 81 aa, Geotrypetes seraphini
KLKPVKFQDVAVYFSEEEWQLLENQQKELYRSVMKENYENLTSLGFTTTKPNILKRMEQGRPLWVSTRRKVIKHSFREGEP

SEQ ID NO: 1605 - protein, 81 aa, Geotrypetes seraphini
VARMQTRVTFDDIAVSFSQEEWEYLDEGQKELYREVMEENLELLTSLGSLVAQPEQMEELYMMDHHDMGLRGTLLSLCTED

SEQ ID NO: 1606 - protein, 81 aa, Geotrypetes seraphini
QMQVTFEEVAISFSQEEWEYLDEEQKELYREVMKENYQTLISLATGSPTVTPKIIAHIERGEEPYIRGEPGSEERETGNSS

SEQ ID NO: 1607 - protein, 81 aa, Geotrypetes seraphini
QIPVIFEDIVIYFSQEEWKDLEEWQKELYKDVMKENYQTLISLGTGFPTPPPDIISHIERGEEPYIRDELESEKRETGKRG

SEQ ID NO: 1608 - protein, 81 aa, Geotrypetes seraphini
QQMQVTFEDVAVSFSQEEWEYLDEGQKELYREVMKENYETVVSLGSPASTPKIISCIECGEEAYIRGEPGSEGRETGKSSC

SEQ ID NO: 1609 - protein, 81 aa, Geotrypetes seraphini
QMPIKFEDIAVSFSQEEWEYLNEEQKELYREVMKENYQTLISLGTGSPPVTPDIISHIERGEEPYIREEPGSEEREPGRSS

SEQ ID NO: 1610 - protein, 81 aa, Colinus virginianus
EPVSFEEVAVYFSREEWALLDPAQRALYRDVMLETYECVASLAPLPGPKPMVISLLEEGEEPWIPDVGSPEAVAGDVSPGE

SEQ ID NO: 1611 - protein, 81 aa, Pelodiscus sinensis
AQGLVPFEEVAVYFTRTEWALLDPAQRALYRAVMQENYENVTSLGFAVSKPDVISQLERGEEPWVPELQGSEHREILGGTG

SEQ ID NO: 1612 - protein, 81 aa, Pelodiscus sinensis
VEPVSFEEVAVYFSEEEWALLDPGQRALYWDVMQENYEAVSWLVRGRGVSKAHVISWVERGEELWIPDRQGCEEGESISDI

SEQ ID NO: 1613 - protein, 81 aa, Pseudonaja textilis
FLPQVTFEDVAIYFSREEWDELSEWQRELYQAVMMENYEAVLSLGKNDFIAQCTWGLREGEKRASGKSEKARNRPVSNLWR

SEQ ID NO: 1614 - protein, 81 aa, Colinus virginianus
PSVPVTFRDVFVQFSRDEWALLDDEQKELHQSVMQSNYEMLMSLYCDLAKPEVSLQMERGEPCLPAEPDLQGTAVSLNPAA

SEQ ID NO: 1615 - protein, 81 aa, Pelodiscus sinensis
FQGPVTFDEVAVYFTKEEWALLDPAQRALYRDVMQENYETVTSLGLPVSRPDVISQMEQGEEPWASALQGSEDRLILRGIC

SEQ ID NO: 1616 - protein, 81 aa, Pelodiscus sinensis
FLMPVTFEEVAVYFTPGQGALLDPAQRALYRDVMQENYETVASLGFSIPKPDLIAQLEQGEEPWVPDLQPSKEMVILRGIC

SEQ ID NO: 1617 - protein, 81 aa, Pelodiscus sinensis
VVEPVSFEEVAVYFSEEEWALLDPGQRALYWAVMQENYEAVSWLGFSIPKPDLITQLDRGEEPWVPDLQPSKKLEILRGTR

SEQ ID NO: 1618 - protein, 81 aa, Pelodiscus sinensis
AQVPVTFEEVAVYFTQGQGALLGPAQRALYRDVMRENYEMVTSLGFPVPKPDLVARLERGEEPWVSDCLASEEGGTRRGRG

SEQ ID NO: 1619 - protein, 81 aa, Pelodiscus sinensis
AQVPVTFEEVAVYFTAGQGALLGPNQRALYRDVMQENYETVASLGFSIPKPDLITQLERGEEPWVPDLQPSKEMEFLRGTC

SEQ ID NO: 1620 - protein, 81 aa, Pelodiscus sinensis
VAGPVTFEEVAVYFSEEEWALLDPGQRALYRDVMQENYEAVSWLGFPVSKPGETSWLERAGKLQEWESRSHANTARPRGNQ

SEQ ID NO: 1621 - protein, 81 aa, Pelodiscus sinensis
SEMRVTFEEVAVYFTKGQGALLDARQKALYRDVMLENYEAVTSLGFPVPKPELIARLERGEEPWVPDLQAGEEREILRGTR

SEQ ID NO: 1622 - protein, 81 aa, Pelodiscus sinensis
DSMRVTFEEVAVYFTPGQGALLGPAQRALYRDVMQENYEAVTSLGFPVPKPELIARLERGEEPWVPDLQAREEREIPRGTC

SEQ ID NO: 1623 - protein, 81 aa, Pelodiscus sinensis
VTFEEVAVYFSAEEWALLGPAQRALYREVMRENYEAVTSLAWAGLPISKPDLISCMERGEEPWVAHLQSQRRRELPRGRNS

SEQ ID NO: 1624 - protein, 81 aa, Geotrypetes seraphini
QMPVKFEDIAVSFSQEEWEYLDEEQKELYREVMKENYQTLISLGTGSPSITPDIISHIERGEEPYIREEPGSEEREPGRSS

SEQ ID NO: 1625 - protein, 81 aa, Geotrypetes seraphini
AQVPVTFEDIAVYFSQEEWEDLEEQQRELYKDVMKENYETLSSLGPPAVTPDIISHIERGEEPYIRFESGPEEREIGKSSC

SEQ ID NO: 1626 - protein, 81 aa, Geotrypetes seraphini
AQMRVTFEDIAVSFSPEEWEYLDQGQKELYREVMKENYEILISLGCPNLTPEIISRIERGEEPYIRGEPGSEERETGKSSC

SEQ ID NO: 1627 - protein, 81 aa, Geotrypetes seraphini
QQVPVTFEDVAVSFSQEEWKYLDEAQKNLYWEVMKENYETLISLDSEVHQEEEREKNQEEYPMLWGLISRQSRKNHEKVYW

SEQ ID NO: 1628 - protein, 81 aa, Gopherus agassizii
FQGPVTFEEVAVYFTSEEWALLDPTQRALYWDVMQENYENVTSLGFPVSKPHIISQLEQGAEPWVPDLQGSEEILSKHQRI

SEQ ID NO: 1629 - protein, 81 aa, Gopherus agassizii
FPMPVTFEEVAVYFTQGQGALLDPAQRALYRDVMQENYKMVTSLAGFPIPKPDLIAQLERGEEPWVPDLQADEERESPRGT

SEQ ID NO: 1630 - protein, 81 aa, Phasianus colchicus
CQEPVSFAQVAVYFSREEWALLDPAQRALYRDVMLETYQCVASLAPLPAPKPVLISQLEGEEDPCISDVRSPEAVPGDLSP

SEQ ID NO: 1631 - protein, 81 aa, Paroedura picta
MLSPVTFEDVAVYFTEGQGALLDPNQRALYREVMMENYENMASLGFLFIKPALISQLEQGEELWAPESQGLDAAEISDTSD

SEQ ID NO: 1632 - protein, 81 aa, Meleagris gallopavo
EEPVSFAEVAVYFSREEWALLDPAQRALYRDVMLETYQCVASMESLLPAPKPIVISLLEGGEDLWIPDMQSPEDVAGDLRP

SEQ ID NO: 1633 - protein, 81 aa, Meleagris gallopavo
EPVSFAEVAVYFSREEWALLDPAQRALYRDVMLETYQCVASLVTETPVPAPKPVLISLLEGRKEPWIPDMRSPEAMPGDLS

SEQ ID NO: 1634 - protein, 81 aa, Meleagris gallopavo
SQEPVSFAEVAVYFSREEWALLDPAQRALYRDVMLETYQCVASLAPLPAPKPMLISLLEGGEEPWIPDVRSPEAVPGDLSP

SEQ ID NO: 1635 - protein, 81 aa, Meleagris gallopavo
SQEPVSFADVAVYFSREEWALLDPAQRVLYRDVMLETYECIASLACPAPKPAVISMLEGEEDPWIPEDMAGDLGPGEPVRE

SEQ ID NO: 1636 - protein, 81 aa, Aquila chrysaetos
GKMPVTFEDVAVYFSPEEWAELAGWQRRLYREVMLENYQAVASLGWPAVKPEIICKMEREEMPCMPAPPRARWRHRTPVPA

SEQ ID NO: 1637 - protein, 81 aa, Mus musculus
MNAVTYEDVHVNFTQEEWALLDPSQKKLYKDVMVETYRNLNAIGFNWEAHNIEEYCQSSRRHRRCERSQSAEKPSEYTQCG

SEQ ID NO: 1638 - protein, 81 aa, Mus musculus
SVEMLSFRDVAIDFSAGELECLEPAQWDLYRDVMLENFSHLVFLGFSFSKPLLVRFLEKNQELRNVKRKAATVPRGKKPYK

SEQ ID NO: 1639 - protein, 81 aa, Homo sapiens
QLQETMTFKDVEVTFSQDEWGWLDSAQRNLYRDVMLENYRNMASLVGPFTKPALISWLEAREPWGLNMQAAQPKGNPVAAP

SEQ ID NO: 1640 - protein, 81 aa, Alligator sinensis
PETVVSFEDVAVRFSPDEWHLLDDGQRRLYRDVLRENYSHVRSLGFPVPDLAVIFRMERGEEPWPPGLPAGTKSDDQEEER

SEQ ID NO: 1641 - protein, 81 aa, Xenopus laevis
AQDPVTFDDISVYFSRDEWALLDAGQKQLYREVMAENYRALVSVGYVMEEPGLVSHIEHEQQGSPIRSRSSLHAGRHCGFI

SEQ ID NO: 1642 - protein, 81 aa, Alligator mississippiensis
PETVVSFEDVAVRFSPDEWHLLDDGQRRLYRDVLRENYSHVRSLGFPVPDLAVIFRMERGEEPWPPGLPAGEWPWGQGQAP

SEQ ID NO: 1643 - protein, 81 aa, Peromyscus maniculatus
YQEALTFQDVKVTFSQEEWGCLDSAQRNLYRDVMLENYGNVVSVVGSSPKPALISWLEARKPSTVNICKVQPKRDSGTAPE

SEQ ID NO: 1644 - protein, 81 aa, Sus scrofa
QPQEALTFKDVEVTFSQDEWGWLDASQRNLYRDVMLENYGNIASLMGPFTKPALISWLETREPWVLNVQGAQPEGNPGADV

SEQ ID NO: 1645 - protein, 81 aa, Suricata suricatta
LLTFEDVAVYFTEEEWALLDPNQKILYNDVMQENYENVICLGLKLKNDTGNDQPTSVSTLEIQASGCKVLRKARIKVAQKT

SEQ ID NO: 1646 - protein, 81 aa, Muntiacus muntjak
QPQGTVTFKDVEVTFSQDEWGLLDASQRNLYRDVMLENYGNMASVVGPFTKPALISWLEAREPWGLNVQGVQFKGNPGAAP

SEQ ID NO: 1647 - protein, 81 aa, Muntiacus muntjak
QLTFEDVALSFSKEEWQIMDPNQKTLYIDVMREIYETVTSLGLKLKNDTGNDQPVSLSTSEIQPSGCKVLRKARMKVAQTT

SEQ ID NO: 1648 - protein, 81 aa, Muntiacus muntjak
SQELLTFKDISVDFTQEEWGQLAPAHRNLYREVMLENYGNLVSVAGCQLSKPSVISQLEKGEEPWMTEKEGPGDPSSDLKS

SEQ ID NO: 1649 - protein, 81 aa, Canis lupus
LLTFEDVAVFFSEEEWKLLNPTQKILYSDVMQENYETVISLGLKLKNDTGNDQPISLSTLELQASGCKVLRKARVKVAQKT

SEQ ID NO: 1650 - protein, 81 aa, Macaca fascicularis
QTDLVTFDSVAVEFTQEEWTLLDPTQRNLYRDVMLENYKNLSSVGYQLFKPSLISWLEEEEELSTLPRVLQEWKMCLKTKG

SEQ ID NO: 1651 - protein, 81 aa, Puma concolor
LLTFEDVAVSFSEEEWKLLDPAQKILYNDVMQENYETVISLGLKLKNDTGNDQPISVSALEIQASGRKVLRKARMKVAQKT

SEQ ID NO: 1652 - protein, 81 aa, Myotis lucifugus
AAQELVTFQDVFVDFSQEELNSLSAAQRRLHREVTLENYRSLVSLGYRFPKPDIIAQLEEEESRAMEEDGDTKTGPDWETG

SEQ ID NO: 1653 - protein, 81 aa, Phascolarctos cinereus
AQDALTFQDVAVDFTWEEWGQLDPAQQNLYRDVMLENYQNLISLGFPVSKPEVISQLEQGEVPWALKRAVAEGSCPDWEAR

SEQ ID NO: 1654 - protein, 81 aa, Bos taurus
AEELVTFEDVAVHFSPEELPYLSASQRNLYREVMLENYRNLVSLGYQFPKPDIISQLEEEESHAREEDGSTVTCQDWEEQS

SEQ ID NO: 1655 - protein, 81 aa, Callithrix jacchus
SQTLVTFKDVFVDFTREEWKLLDTAQQIVYRNVMLENYKNLVSLGYQLTKPDVILRLEKGEEPWVVERGIHQETHPDSETA

SEQ ID NO: 1656 - protein, 81 aa, Odocoileus virginianus
PQEPVTFADVAVLFTPEEWLFLDSAQKSLYRDVMLENYRNLASVGDQLCKTRMSSHMEQREELCVTERGVFPGAQLGPHLQ

SEQ ID NO: 1657 - protein, 81 aa, Ovis aries
SYRSKTMAQGSLTFSDVAIGFSQQEWECLDPVQKTLYRDVMMENYGNLVSLGHSISKPNVITLLEQGKEPWIVVREETRSW

SEQ ID NO: 1658 - protein, 81 aa, Cebus imitator
AELPVVFEDVAVYFTREEWGMLDKRQKELYRDVMRMNYELMASLGPAAAKPDLISKLERRAAPWIKDPNGPKWGKGRPPGN

SEQ ID NO: 1659 - protein, 81 aa, Vulpes vulpes
SQELLTFKDIFVDFTQEEWGQLAPAHRNLYREVMLENYGNLVSVGYQLSKPGVISQLEKGEEPWLIEREISGSPSSDLENK

SEQ ID NO: 1660 - protein, 81 aa, Callithrix jacchus
EELPVVFEDVAVYFTREEWGMLDKRQKELYRDVMRMNYELLASLGPAAAKPDLISKLERRAAPWIKHPNGPKWGKGRPPGN

SEQ ID NO: 1661 - protein, 81 aa, Pongo sp.
SQEPVTFADVAVVFTPEEWVFLDSTQRSLYRDVMLENYRNLASVADQLCKPNALSYLEERGEQWTTDRGILSDTCAEPQCQ

SEQ ID NO: 1662 - protein, 81 aa, Bison bison
PQEPVTFADVAVLFTPEEWLFLDSAQKSLYRDVMLENYRNLASVGDQLCKTRMSSHLEQREELCVTERGIFPGAHLGPHFQ

SEQ ID NO: 1663 - protein, 81 aa, Vulpes vulpes
SQELLTFKDVSVDFTQEEWGQLSLAHRNLYREVMLENYGNLVSVAGYQLSKPSVISQLEKGQEPWMTEKKGPGDPSPDLKN

SEQ ID NO: 1664 - protein, 81 aa, Camelus dromedarius
LLTFEDVALSFTEEEWQLLDPTQKILYNDVMQENYETVISLGLKLKNDTGNDQPISLSTLEIQGSGCKVLRKARVKVAQKT

SEQ ID NO: 1665 - protein, 81 aa, Neomonachus schauinslandi
SQGLLTFKDISVDFTQEEWGQLAPAHRNLYREVMLENYGNLVSVAGYQLSKPSVISQLEKGQEPWMTEKEGPGDSSSDLKN

SEQ ID NO: 1666 - protein, 81 aa, Enhydra lutris
LLTFEDVAVSFSEEEWRLLDPTQKSLYNDVMQENYETVVSLGLKLKNDTGNDQPISLSALEIQASGCRVLRKARMKVAQKT

SEQ ID NO: 1667 - protein, 81 aa, Enhydra lutris
SQELLTFKDISVDFTQEEWGQLPLAHRNLYREVMLENYGNLVSVAGYQLSKPSVISQLEKGQEPWMTEKEVPEDPSSDLRT

SEQ ID NO: 1668 - protein, 81 aa, Physeter macrocephalus
LLTFEDVALFFTEEEWQLLDPAQKILYYNVMQENYETVTSLGLKLKNDTGNDQPISLSTLEIQASGCKVLRKARMKVAQKT

SEQ ID NO: 1669 - protein, 81 aa, Aotus trivirgatus
EELPVVFEDVAVYFTREEWGMLDKRQKELYRDVMRMNYELLASLGPAAAKPDLISKLERRAAPWIRDPNGPKWGKGRPSGN

SEQ ID NO: 1670 - protein, 81 aa, Odocoileus virginianus
QLTFEDVALSFSKEEWQIMDPNQKTLYIDVMQEIYETVTSLGLKLKNDTGNDQPVSLSTSEIQPSGCKVLRKARMKVAQTT

SEQ ID NO: 1671 - protein, 81 aa, Callithrix jacchus
QLQETMTFKDVEVTFSQDEWGLLDSAQRNLYRDVMLENYRNMAFLVGPFTKPALISWLEAREPWGLNVQVAQPKRNPGAAP

SEQ ID NO: 1672 - protein, 81 aa, Capra hircus
QPQGTVTFKDVEVTFSQDEWGLLDASQRNLYRDVMLENYGNMASVVGPFTKPALISWLEAREPWGLNVQGVQLKGNPGAAP

SEQ ID NO: 1673 - protein, 81 aa, Pteropus vampyrus
AEVPVAFEDVAVYFTQEEWGSLDKRQKELYRDVMWMNYELLASLGPAAAKPDLISKLERRAAPWIKDTRGPKWGKGKRKTV

SEQ ID NO: 1674 - protein, 81 aa, Pan paniscus
EELPVVFEDVAVYFTREEWGMLDKRQKELYRDVMRMNYELLASLGPAAAKPDLISKLERRAAPWIKDPNGAKSGGKGRPPG

SEQ ID NO: 1675 - protein, 81 aa, Homo sapiens
SQEPVTFADVAVVFTPEEWVFLDSTQRSLYRDVMLENYRNLASVADQLCKPNALSYLEERGEQWTTDRGVLPDTCAEPQCQ

SEQ ID NO: 1676 - protein, 81 aa, Gulo gulo
LLTFEDVAVSFSEEEWRLLDPAQKSLYNDVMQENYETIVSLGLKLKNDTGNDQPISLSALEIQASGCRVLRKARMKVAQKT

SEQ ID NO: 1677 - protein, 81 aa, Erinaceus europaeus
FQELVTFEDVCVDFTSEELSCLSTSQRTLYREVMLENYRNLVSLGHQFSKPELISRLEEEEFQAMAADSSAVAGDSGAVAG

SEQ ID NO: 1678 - protein, 81 aa, Muntiacus reevesi
EALPVVFEDVAVYFTREEWGALDKRQKEMYRDVMRMNYELLASLGPAAAKPDLISKLERRAAPWIKDPHGLKWGKGRPPGK

SEQ ID NO: 1679 - protein, 81 aa, Propithecus coquereli
QPQEAMTFKDVEVTFSQDEWGSLDSAQRNLYRDVMLENYRNMVSLVGPFTKPALISWLEAREPWGLNVQAAQPKGNPGAAP

SEQ ID NO: 1680 - protein, 81 aa, Propithecus coquereli
EELPAVFEDVAVYFTREEWGMLDKRQKELYRDVMRLNYELLASLGPAAAKPDLISKLERRAAPWIKDPNGPKWGKGGPPGK

SEQ ID NO: 1681 - protein, 81 aa, Rhinolophus ferrumequinum
EELPVAFEDVAVYFTREEWGMLDKRRKELYRDVMRRNYELLASLGPAAAKPDLISKLERGAAPWIKDPNGPKWGKGKKKMV

SEQ ID NO: 1682 - protein, 81 aa, Rhinolophus ferrumequinum
MAEGLKFKDVAIYFSQNEWECLHSAQKDLYRDIMLENYNNLISLGLSESKPDVISLLEQRKEPWMVERKETKEWFPDWESR

SEQ ID NO: 1683 - protein, 81 aa, Microcaecilia unicolor
QVPVTFEDITVYFSREQWEYLDEGQKELYREVMKENYETLISLGTGPEGFNPEVLARIKLEEESHVWDPKEPGQKEVTRSY

SEQ ID NO: 1684 - protein, 81 aa, Camelus ferus
EELPVVFEDVAVYFTREEWGVLDKRQKELYRDVMRMNYELLASLGPAAAKPDLISKLERRAAPWIKDPNGPKWGKGRVPAC

SEQ ID NO: 1685 - protein, 84 aa, Mus musculus
LTYDDVYVNFTQEEWALLNPSQKSLYKDVMLETYRNLIAVGYNWEDHNIEEHCQSSRRHGRNERILTGENPYEGIQCGEAFVHH

SEQ ID NO: 1686 - protein, 92 aa, Xenopus tropicalis
VKFDEVAVVFSEDEWNLLTDQQRGLYMEVMKENYEHLIYLGFEVPVILSLLQDGGGIGSDTVTQSKSQQVAGAEESKSSVTLEGPIPETLPS

SEQ ID NO: 1687 - protein, 93 aa, Chelonia mydas
VTFQEVAVCFTEEEWALLDPGQRALYRVVMQENYEAVTSLVAKGNKNSLCQTFCLCWGSPSSMLFCSPSLLQGLQKPQDCRGLYGGAPQCQTV

SEQ ID NO: 1688 - protein, 84 aa, Peromyscus maniculatus
VTYNDVHIDFTWEEWTLLDLSQKNLYKDVMLETYWNLLTIGYSWEDHNIEEHCQSSRRYERHERSQAGEKPSIYTQCIKAFEHL

SEQ ID NO: 1689 - protein, 83 aa, Mesocricetus auratus
VTYDDVCIDFTWEEWTLLDPSQKKLYKDVMLETYRNLTAIGYNWENHHVEEYYQSSRRNARNEKSQTAEKPSVNTQCVKAFTH

SEQ ID NO: 1690 - protein, 84 aa, Mesocricetus auratus
VSFEDVAVHFTQEEWALLDPSQKSLYRDVMLETCRNLAAIGYIWEEQTIEDDCKNFGRYQRHTISHSEYTPYEHEECGNMPCDP

SEQ ID NO: 1691 - protein, 84 aa, Mus caroli
VTYEDVHVNFSHEEWALLDSSQKSLYRDVMLETCRNLMAIGYRLEDHNIEEHCQSSRRPGRYNICNCGYKPCENEDHGKKQCTF

SEQ ID NO: 1692 - protein, 83 aa, Mus caroli
MTYDDVHVNFTGEEWALLSPSQKRLYKDVMLETYRNLTAIGYNWEDHNSEHFQHSRRHGRHERRHTGEKPSVYTQCGKVFAYH

SEQ ID NO: 1693 - protein, 93 aa, Mus caroli
VTYEDVHVNFTQEEWALLDPSQKKLYKDVMLETYRNLNAIGFSWEAQNIEEHCQSFGRHRRCERSQRAEKPSEYTQPDKGFALRAHSHAQRHE

SEQ ID NO: 1694 - protein, 84 aa, Cricetulus griseus
LTYDDVQINFTSEEWSLLDTSQKNLYKDVMLETYKNLTDIGYTWEDCSIEEHCASSKRKERPKRSQTGEKPSAYTQCAKDFAYS

SEQ ID NO: 1695 - protein, 84 aa, Peromyscus maniculatus
ITYDDVHVNFTWEEWTLLDPFQKNLYKDVMLETYRNLTTIGYSWEDSNIEVHCQSSGRHERHERSHTGEKPSVYTQCVETFAHH

SEQ ID NO: 1696 - protein, 84 aa, Peromyscus maniculatus
VTYDDVHIDFTWEEWTLLDPSQKNLYKDVMLETYRNLTTVGYSWEDHLIEEHCKSSRKHERHERIPTGEQPSESTQSFRAFAHH

SEQ ID NO: 1697 - protein, 82 aa, Mesocricetus auratus
VTFEDVAVNFTSGEWALLDSSQKKLYRDVMKETFLNLISIEKGLEPNIEEHYKDFCRNLRTQLVEKDWGYEYNRQWDDNLQT

SEQ ID NO: 1698 - protein, 92 aa, Erinaceus europaeus
VTYEDVTVTFTQEEWALLNPSEKKLYRDVMWENLRNIFSTGKIQGDNYNEEQHNHQGSKQSCRVVKISGGQKRSQNDEKQRMQSEGKSYECE

SEQ ID NO: 1699 - protein, 87 aa, Nomascus leucogenys
VAFEDVAVNFTQEEWALLNSSQKNLYREVMQETCRNLASVGSKWKDQNIEDHFEKPGKNIRKHMVQKLCESKEGSQYGEVVSQIPNL

SEQ ID NO: 1700 - protein, 87 aa, Rhinopithecus roxellana
VAFEDVAVNFTQEEWALLDPSQKNLYREVMQETLRNLASIGKKWNNQYIEDEHQNPRRNLRRLIKERLSESKESHQHGEFLTQVPDD

SEQ ID NO: 1701 - protein, 89 aa, Bison bison
VVFEDVAVNFTLEEWALLDSSQKELYRDVMLETFRNLASVDGETQYKANGSVSQQDIYRNKISKEHKISKFTGNDSWPFVLGKIWEELS

SEQ ID NO: 1702 - protein, 114 aa, Callithrix jacchus
VTFEDIAVYFSREEWGLLDEAQRCLYHDVMLENFSLMTSVGCLHGIGAEEAPSEQIVSVETVSQARTPKPSSSIPNAHSCEMCILVMKDILYLTEHQGTLPWQKPYTSAASGKW

SEQ ID NO: 1703 - protein, 84 aa, Macaca mulatta
LTFEDVAVYFSEEEWQLLDPPEKTLYNDVMQDIYETVISLGLKLKNDTGNDHPISVSTSEIQTSGCKVSKKTRMKIAQKTMGRE

SEQ ID NO: 1704 - protein, 83 aa, Pan troglodytes
VTFKDVAVIFTEEELGLLDPAQRKLYRDVMLENFRNLLSVGHQPFHGDTFHFLREEKFWVMGTTSQREGNLGGKIQTEMETVP

SEQ ID NO: 1705 - protein, 87 aa, Vicugna pacos
VTFEDVAVNFSLEEWALLDLSQKKLYRDVMQETFRNLASVGEKWDNHNIEDWNKTQGRKLRSHMVEKLSESKEGGQHGETASQIPNL

SEQ ID NO: 1706 - protein, 84 aa, Homo sapiens
LTFEDVAVYFSEEEWQLLNPLEKTLYNDVMQDIYETVISLGLKLKNDTGNDHPISVSTSEIQTSGCEVSKKTRMKIAQKTMGRE

SEQ ID NO: 1707 - protein, 91 aa, Propithecus coquereli
VTFEDVAVNFTPQEWALLDPSQKNLYRDVMQETLRNLASVGKKWKDQNMEDECKTPRRNLRSVVGERLFTSKEGSQCGETLNLDSHHMLKK

SEQ ID NO: 1708 - protein, 92 aa, Balaenoptera acutorostrata
VVFEDVAVYFSQEEWGLLDEAQRHLYHAVMTENFALVTSLGCWHGAQDEEAPSEQSISVGMSEVGTPKPDPSTKKGQPYEMCEPLSKDLLHL

SEQ ID NO: 1709 - protein, 93 aa, Notechis scutatus
VSFEEVAVHFSEEEWSQLDPAQKALHGEVMLENSRNLASLGYNEHGNKNCKEQCQPVDPNEQNRNFADQMQTKIDETNQSQSEVEKTFHSTHH

SEQ ID NO: 1710 - protein, 97 aa, Rhinolophus ferrumequinum
EKIEDMAVSLIREEWLLDPSQKDLRRDNRTENYRNMFSLGGETRSENRELASKQVASAGVQPHGETAARCNGDVTGALEHGEARDLLGSRVERQRAN

SEQ ID NO: 1711 - protein, 80 aa, Homo sapiens
AFEDVAVYFSQEEWGLLDTAQRALYRRVMLDNFALVASLGLSTSRPRVVIQLERGEEPWVPSGTDTTLSRTTYRRRNPGS

SEQ ID NO: 1712 - protein, 80 aa, Homo sapiens
RESLEDEVTPGLPTAESQELLTFKDISIDFTQEEWGQLAPAHQNLYREVMLENYSNLVSVGYQLSKPSVISQLEKGEEPW

SEQ ID NO: 1713 - protein, 80 aa, Homo sapiens
ALRSVMFSDVSIDFSPEEWEYLDLEQKDLYRDVMLENYSNLVSLGCFISKPDVISSLEQGKEPWKVVRKGRRQYPDLETK

SEQ ID NO: 1714 - protein, 80 aa, Homo sapiens
DSVAFEDVAVNFTQEEWALLSPSQKNLYRDVTLETFRNLASVGIQWKDQDIENLYQNLGIKLRSLVERLCGRKEGNEHRE

SEQ ID NO: 1715 - protein, 80 aa, Homo sapiens
SQVTFSDVAIDFSHEEWACLDSAQRDLYKDVMVQNYENLVSVGLSVTKPYVIMLLEDGKEPWMMEKKLSKAYPFPLSHSV

SEQ ID NO: 1716 - protein, 80 aa, Homo sapiens
GPQGARRQAFLAFGDVTVDFTQKEWRLLSPAQRALYREVTLENYSHLVSLGILHSKPELIRRLEQGEVPWGEERRRRPGP

SEQ ID NO: 1717 - protein, 80 aa, Homo sapiens
NVEVVKVMPQDLVTFKDVAIDFSQEEWQWMNPAQKRLYRSMMLENYQSLVSLGLCISKPYVISLLEQGREPWEMTSEMTR

SEQ ID NO: 1718 - protein, 80 aa, Homo sapiens
EETQGELTSSCGSKTMANVSLAFRDVSIDLSQEEWECLDAVQRDLYKDVMLENYSNLVSLGYTIPKPDVITLLEQEKEPW

SEQ ID NO: 1719 - protein, 80 aa, Homo sapiens
DTVVFEDVVVDFTLEEWALLNPAQRKLYRDVMLETFKHLASVDNEAQLKASGSISQQDTSGEKLSLKQKIEKFTRKNIWA

SEQ ID NO: 1720 - protein, 80 aa, Homo sapiens
GSLEEGRRATGLPAAQVQEPVTFKDVAVDFTQEEWGQLDLVQRTLYRDVMLETYGHLLSVGNQIAKPEVISLLEQGEEPW

SEQ ID NO: 1721 - protein, 80 aa, Homo sapiens
TQPDEDLHLQAEETQLVKESVTFKDVAIDFTLEEWRLMDPTQRNLHKDVMLENYRNLVSLGLAVSKPDMISHLENGKGPW

SEQ ID NO: 1722 - protein, 80 aa, Homo sapiens
NMSQASVSFQDVTVEFTREEWQHLGPVERTLYRDVMLENYSHLISVGYCITKPKVISKLEKGEEPWSLEDEFLNQRYPGY

SEQ ID NO: 1723 - protein, 80 aa, Homo sapiens
EPLKFRDVAIEFSLEEWQCLDTIQQNLYRNVMLENYRNLVFLGIVVSKPDLITCLEQEKEPWTRKRHRMVAEPPVICSHF

SEQ ID NO: 1724 - protein, 80 aa, Homo sapiens
RVLTFRDVAVEFSPEEWECLDSAQQRLYRDVMLENYGNLFSLGLAIFKPDLITYLEQRKEPWNARRQKTVAKHPAGSLHF

SEQ ID NO: 1725 - protein, 80 aa, Homo sapiens
NMEGLVMFQDLSIDFSQEEWECLDAAQKDLYRDVMMENYSSLVSLGLSIPKPDVISLLEQGKEPWMVSRDVLGGWCRDSE

SEQ ID NO: 1726 - protein, 80 aa, Homo sapiens
QDPSAEGLSEEVPVVFEELPVVFEDVAVYFTREEWGMLDKRQKELYRDVMRMNYELLASLGPAAAKPDLISKLERRAAPW

SEQ ID NO: 1727 - protein, 10 aa, synthetic construct
  VARIANT 2: note = K or R
  VARIANT 3: note = A, D, E, G, N, S, or T
  VARIANT 7: note = D, E, or S
  VARIANT 10: note = L or R
QXXLYRXVMX

SEQ ID NO: 1728 - protein, 15 aa, synthetic construct
  VARIANT 1: note = A, L, P, or S
  VARIANT 2: note = L or V
  VARIANT 3: note = S or T
  VARIANT 5: note = A, E, G, K, or R
  VARIANT 8: note = A or T
  VARIANT 9: note = I or V
  VARIANT 10: note = D, E, N, or Y
  VARIANT 12: note = S or T
  VARIANT 13: note = E, P, Q, R, or W
  VARIANT 14: note = E or N
  VARIANT 15: note = E or Q
XXXFXDVXXXFXXXX

SEQ ID NO: 1729 - protein, 15 aa, synthetic construct
  VARIANT 3: note = K or R
  VARIANT 4: note = D or E
  VARIANT 7: note = L, Q or R
  VARIANT 9: note = N or T
  VARIANT 10: note = F or Y
  VARIANT 11: note = A, E, G, Q, R or S
  VARIANT 12: note = H, L, or N
  VARIANT 13: note = L or V
  VARIANT 14: note = A, G, I, L, T or V
  VARIANT 15: note = A, F, or S
LYXXVMXEXXXXXXX

SEQ ID NO: 1730 - protein, 14 aa, synthetic construct
  VARIANT 2: note = A, E, G, K or R
  VARIANT 5: note = A, S or T
  VARIANT 6: note = I or V
  VARIANT 7: note = D, E, N or Y
  VARIANT 9: note = S or T
  VARIANT 10: note = E, L, P, Q, R or W
  VARIANT 11: note = D or E
  VARIANT 14: note = A, E, G, Q or R
FXDVXXXFXXXEWX

SEQ ID NO: 1731 - RNA, 108 nt, synthetic construct
  source 1..108: mol_type = other RNA
acatctggcgcgtttattccattactttggagccagtcccagcgactatgtcgtatggacgaagcgcttatttatcggagagaaaccgataagtaaaacgcatcaaag

SEQ ID NO: 1732 - RNA, 108 nt, synthetic construct
  source 1..108: mol_type = other RNA
tactggcgcttttatctcattactttgagagccatcaccagcgactatgtcgtatgggtaaagcgcttatttatcggagagaaatccgataaataagaagcatcaaag

SEQ ID NO: 1733 - RNA, 81 nt, synthetic construct
  source 1..81: mol_type = other RNA
acatctggcgcgtttattccattactttggagccagtcccagcgactatgtcgtatggacgaagcgcttatttatcggaga

SEQ ID NO: 1734 - RNA, 78 nt, synthetic construct
  source 1..78: mol_type = other RNA
acatctggcgcgtttattccattactttggagccagtcccagcgactatgtcgtatggacgaagcgcttatttatcgg

SEQ ID NO: 1735 - RNA, 80 nt, synthetic construct
  source 1..80: mol_type = other RNA
tactggcgcttttatctcattactttgagagccatcaccagcgactatgtcgtatgggtaaagcgcttatttatcggaga

SEQ ID NO: 1736 - RNA, 77 nt, synthetic construct
  source 1..77: mol_type = other RNA
tactggcgcttttatctcattactttgagagccatcaccagcgactatgtcgtatgggtaaagcgcttatttatcgg

SEQ ID NO: 1737 - RNA, 25 nt, synthetic construct
  source 1..25: mol_type = other RNA
gtttacacactccctctcatagggt

SEQ ID NO: 1738 - RNA, 25 nt, synthetic construct
  source 1..25: mol_type = other RNA
gtttacacactccctctcatgaggt

SEQ ID NO: 1739 - RNA, 25 nt, synthetic construct
  source 1..25: mol_type = other RNA
ttttacataccccctctcatgggat

SEQ ID NO: 1740 - RNA, 25 nt, synthetic construct
  source 1..25: mol_type = other RNA
gtttacacactccctctcatggggg

SEQ ID NO: 1741 - RNA, 20 nt, synthetic construct
  source 1..20: mol_type = other RNA
ccagcgactatgtcgtatgg

SEQ ID NO: 1742 - RNA, 39 nt, synthetic construct
  source 1..39: mol_type = other RNA
gcgcttatttatcggagagaaatccgataaataagaagc

SEQ ID NO: 1743 - RNA, 74 nt, synthetic construct
  source 1..74: mol_type = other RNA
ggcgcttttatctcattactttgagagccatcaccagcgactatgtcgtatgggtaaagcgcttatttatcgga

SEQ ID NO: 1744 - RNA, 89 nt, synthetic construct
  source 1..89: mol_type = other RNA
actggcgcttttatctgattactttgagagccatcaccagcgactatgtcgtagtgggtaaagctccctcttcggagggagcatcaaag

SEQ ID NO: 1745 - RNA, 99 nt, synthetic construct
  source 1..99: mol_type = other RNA
actggcgcttctatctgattactctgagcgccatcaccagcgactatgtcgtagtgggtaaagccgcttacggacttcggtccgtaagaggcatcagag

SEQ ID NO: 1746 - RNA, 89 nt, synthetic construct
  source 1..89: mol_type = other RNA
actggcgcttctatctgattactctgagcgccatcaccagcgactatgtcgtagtgggtaaagctccctcttcggagggagcatcagag

SEQ ID NO: 1747 - RNA, 97 nt, synthetic construct
  source 1..97: mol_type = other RNA
actggcgcctttatctcattactttgagagccatcaccagcgactatgtcgtatgggtaaagcgcttacggacttcggtccgtaagaagcatcaaag

SEQ ID NO: 1748 - RNA, 89 nt, synthetic construct
  source 1..89: mol_type = other RNA
gctggcgcttttatctgattactttgagagccatcaccagcgactatgtcgtagtgggtaaagctccctcttcggagggagcatcaaag

SEQ ID NO: 1749 - RNA, 88 nt, synthetic construct
  source 1..88: mol_type = other RNA
actggcgcttttatctgattactttgagagccatcaccagcgactatgtcgtatgggtaaagctccctcttcggagggagcatcaaag

SEQ ID NO: 1750 - RNA, 151 nt, synthetic construct
  source 1..151: mol_type = other RNA
actggcgcttttatctgattactttgagagccatcaccagcgactatgtcgtagtgggtaaataggagctgcactatgggcgcagtgtcattgacgctgacggtacaggccagacaattattgtctggtatagtgcagctcctaatcaaag

SEQ ID NO: 1751 - RNA, 97 nt, synthetic construct
  source 1..97: mol_type = other RNA
actggcgcctttatctgattactttgagagccatcaccagcgactatgtcgtatgggtaaagcgcttacggacttcggtccgtaagaagcatcaaag

SEQ ID NO: 1752 - RNA, 97 nt, synthetic construct
  source 1..97: mol_type = other RNA
actggcgcttttatctgattactttgagagccatcaccagcgactatgtcgtatgggtaaagcgcttacggacttcggtccgtaagaagcatcaaag

SEQ ID NO: 1753 - RNA, 98 nt, synthetic construct
  source 1..98: mol_type = other RNA
actggcgcttttatctgattactttgagagccatcaccagcgactatgtcgtagtgggtaaagcgcttacggacttcggtccgtaagaagcatcaaag

SEQ ID NO: 1754 - RNA, 89 nt, synthetic construct
  source 1..89: mol_type = other RNA
actggcgcttttatctgattactttgagagccatcaccagcgactatgtcgtattgggtaaagctccctcttcggagggagcatcaaag

SEQ ID NO: 1755 - RNA, 98 nt, synthetic construct
  source 1..98: mol_type = other RNA
actggcgcttttatctgattactttgagagccatcaccagcgactatgtcgtattgggtaaagcgcttacggacttcggtccgtaagaagcatcaaag

SEQ ID NO: 1756 - RNA, 98 nt, synthetic construct
  source 1..98: mol_type = other RNA
actggcgcctttatcatcattactttgagagccatcaccagcgactatgtcgtatgggtaaagcgcttacggacttcggtccgtaagaagcatcaaag

SEQ ID NO: 1757 - RNA, 90 nt, synthetic construct
  source 1..90: mol_type = other RNA
actggcgcttttatctgattactttgagagccatcaccagcgactatgtcgtagtgggtaaagcgccctcttcggagggaagcatcaaag

SEQ ID NO: 1758 - RNA, 89 nt, synthetic construct
  source 1..89: mol_type = other RNA
actggcacttttacctgattactttgagagccaacaccagcgactatgtcgtagtgggtaaagctccctcttcggagggagcatcaaag

SEQ ID NO: 1759 - RNA, 89 nt, synthetic construct
  source 1..89: mol_type = other RNA
actggcacttttatctgattactttgagagccatcaccagcgactatgtcgtagtgggtaaagctccctcttcggagggagcatcaaag

SEQ ID NO: 1760 - RNA, 89 nt, synthetic construct
  source 1..89: mol_type = other RNA
actggcccttttatctgattactttgagagccatcaccagcgactatgtcgtagtgggtaaagctccctcttcggagggagcatcaaag

SEQ ID NO: 1761 - RNA, 89 nt, synthetic construct
  source 1..89: mol_type = other RNA
actggcgcttttacctgattactttgagagccatcaccagcgactatgtcgtagtgggtaaagctccctcttcggagggagcatcaaag

SEQ ID NO: 1762 - RNA, 89 nt, synthetic construct
  source 1..89: mol_type = other RNA
actggcgcttttatctgattactttgagagccaacaccagcgactatgtcgtagtgggtaaagctccctcttcggagggagcatcaaag

SEQ ID NO: 1763 - RNA, 97 nt, synthetic construct
  source 1..97: mol_type = other RNA
actggcacctttacctgattactttgagagccaacaccagcgactatgtcgtatgggtaaagcgcttacggacttcggtccgtaagaagcatcaaag

SEQ ID NO: 1764 - RNA, 97 nt, synthetic construct
  source 1..97: mol_type = other RNA
actggcacctttatctgattactttgagagccatcaccagcgactatgtcgtatgggtaaagcgcttacggacttcggtccgtaagaagcatcaaag

SEQ ID NO: 1765 - RNA, 97 nt, synthetic construct
  source 1..97: mol_type = other RNA
actggcccctttatctgattactttgagagccatcaccagcgactatgtcgtatgggtaaagcgcttacggacttcggtccgtaagaagcatcaaag

SEQ ID NO: 1766 - RNA, 97 nt, synthetic construct
  source 1..97: mol_type = other RNA
actggcgcctttatctgattactttgagagccaacaccagcgactatgtcgtatgggtaaagcgcttacggacttcggtccgtaagaagcatcaaag

SEQ ID NO: 1767 - RNA, 90 nt, synthetic construct
  source 1..90: mol_type = other RNA
gactggcgcttttatctgattactttgagagccatcaccagcgactatgtcgtagtgggtaaagctccctcttcggagggagcatcaaag

SEQ ID NO: 1768 - RNA, 90 nt, synthetic construct
  source 1..90: mol_type = other RNA
actggcgcctttatctgattactttggagagccatcaccagcgactatgtcgtagtgggtaaagctccctcttcggagggagcatcaaag

SEQ ID NO: 1769 - RNA, 89 nt, synthetic construct
  source 1..89: mol_type = other RNA
actggcgcatttatctgattactttgtgagccatcaccagcgactatgtcgtagtgggtaaagctccctcttcggagggagcatcaaag

SEQ ID NO: 1770 - RNA, 89 nt, synthetic construct
  source 1..89: mol_type = other RNA
actggcgcctttatctgattactttgagagccatcaccagcgactatgtcgtagtgggtaaagctccctcttcggagggagcatcaaag

SEQ ID NO: 1771 - RNA, 90 nt, synthetic construct
  source 1..90: mol_type = other RNA
actggcgcttttatctgattactttggagagccatcaccagcgactatgtcgtagtgggtaaagctccctcttcggagggagcatcaaag

SEQ ID NO: 1772 - RNA, 89 nt, synthetic construct
  source 1..89: mol_type = other RNA
actggcgcatttatctgattactttgagagccatcaccagcgactatgtcgtagtgggtaaagctccctcttcggagggagcatcaaag

SEQ ID NO: 1773 - RNA, 89 nt, synthetic construct
  source 1..89: mol_type = other RNA
actggcgcttttatctgattactttgtgagccatcaccagcgactatgtcgtagtgggtaaagctccctcttcggagggagcatcaaag

SEQ ID NO: 1774 - RNA, 90 nt, synthetic construct
  source 1..90: mol_type = other RNA
actggcgcttttattctgattactttgagagccatcaccagcgactatgtcgtagtgggtaaagctccctcttcggagggagcatcaaag

SEQ ID NO: 1775 - RNA, 88 nt, synthetic construct
  source 1..88: mol_type = other RNA
acggcgcttttatctgattactttgagagccatcaccagcgactatgtcgtagtgggtaaagctccctcttcggagggagcatcaaag

SEQ ID NO: 1776 - RNA, 89 nt, synthetic construct
  source 1..89: mol_type = other RNA
actggcgcttttatatgattactttgagagccatcaccagcgactatgtcgtagtgggtaaagctccctcttcggagggagcatcaaag

SEQ ID NO: 1777 - RNA, 90 nt, synthetic construct
  source 1..90: mol_type = other RNA
actggcgcttttatcttgattactttgagagccatcaccagcgactatgtcgtagtgggtaaagctccctcttcggagggagcatcaaag

SEQ ID NO: 1778 - RNA, 89 nt, synthetic construct
  source 1..89: mol_type = other RNA
actggcgcttttatctgattactttgagagccagcaccagcgactatgtcgtagtgggtaaagctccctcttcggagggagcatcaaag

SEQ ID NO: 1779 - RNA, 89 nt, synthetic construct
  source 1..89: mol_type = other RNA
actggcgctgttatctgattacttcgagagccatcaccagcgactatgtcgtagtgggtaaagctccctcttcggagggagcatcgaag

SEQ ID NO: 1780 - RNA, 89 nt, synthetic construct
  source 1..89: mol_type = other RNA
actggcgctcttatctgattacttcgagagccatcaccagcgactatgtcgtagtgggtaaagctccctcttcggagggagcatcgaag

SEQ ID NO: 1781 - RNA, 89 nt, synthetic construct
  source 1..89: mol_type = other RNA
actggcgcttgtatctgattactctgagagccatcaccagcgactatgtcgtagtgggtaaagctccctcttcggagggagcatcagag

SEQ ID NO: 1782 - RNA, 89 nt, synthetic construct
  source 1..89: mol_type = other RNA
actggcgcttctatctgattactctgagagccatcaccagcgactatgtcgtagtgggtaaagctccctcttcggagggagcatcagag

SEQ ID NO: 1783 - RNA, 89 nt, synthetic construct
  source 1..89: mol_type = other RNA
actggcgctttgatctgattaccttgagagccatcaccagcgactatgtcgtagtgggtaaagctccctcttcggagggagcatcaagg

SEQ ID NO: 1784 - RNA, 89 nt, synthetic construct
  source 1..89: mol_type = other RNA
actggcgctttcatctgattaccttgagagccatcaccagcgactatgtcgtagtgggtaaagctccctcttcggagggagcatcaagg

SEQ ID NO: 1785 - RNA, 89 nt, synthetic construct
  source 1..89: mol_type = other RNA
actggcgctgttatctgattactttgagagccatcaccagcgactatgtcgtagtgggtaaagctccctcttcggagggagcatcaaag

SEQ ID NO: 1786 - RNA, 89 nt, synthetic construct
  source 1..89: mol_type = other RNA
actggcgcttttatctgattactttgagagccatcaccagcgactatgtcgtagtgggtaaagctccctcttcggagggagcatcgaag

SEQ ID NO: 1787 - RNA, 89 nt, synthetic construct
  source 1..89: mol_type = other RNA
actggcgcttttatctgattacttcgagagccatcaccagcgactatgtcgtagtgggtaaagctccctcttcggagggagcatcaaag

SEQ ID NO: 1788 - RNA, 98 nt, synthetic construct
  source 1..98: mol_type = other RNA
actggcacttctatctgattactctgagagccatcaccagcgactatgtcgtatgggtaaagccgcttacggacttcggtccgtaagaggcatcagag

SEQ ID NO: 1789 - RNA, 89 nt, synthetic construct
  source 1..89: mol_type = other RNA
actggcacttctatctgattactctgagagccatcaccagcgactatgtcgtagtgggtaaagctccctcttcggagggagcatcagag

SEQ ID NO: 1790 - RNA, 98 nt, synthetic construct
  source 1..98: mol_type = other RNA
actggcacctttatctgattactttgagagccatcaccagcgactatgtcgtatgggtaaagccgcttacggacttcggtccgtaagaggcatcaaag

SEQ ID NO: 1791 - RNA, 98 nt, synthetic construct
  source 1..98: mol_type = other RNA
actggcacttgtatctgattactctgagagccatcaccagcgactatgtcgtatgggtaaagccgcttacggacttcggtccgtaagaggcatcagag

SEQ ID NO: 1792 - RNA, 89 nt, synthetic construct
  source 1..89: mol_type = other RNA
actggcacttgtatctgattactctgagagccatcaccagcgactatgtcgtagtgggtaaagctccctcttcggagggagcatcagag

SEQ ID NO: 1793 - RNA, 97 nt, synthetic construct
  source 1..97: mol_type = other RNA
actggcacttctatctgattactctgagagccatcaccagcgactatgtcgtatgggtaaagcgcttacggacttcggtccgtaagaagcatcagag

SEQ ID NO: 1794 - RNA, 98 nt, synthetic construct
  source 1..98: mol_type = other RNA
actggcgcttctatctgattactctgagagccatcaccagcgactatgtcgtatgggtaaagccgcttacggacttcggtccgtaagaggcatcagag

SEQ ID NO: 1795 - RNA, 98 nt, synthetic construct
  source 1..98: mol_type = other RNA
actggcacttctatctgattactctgagcgccatcaccagcgactatgtcgtatgggtaaagccgcttacggacttcggtccgtaagaggcatcagag

SEQ ID NO: 1796 - RNA, 98 nt, synthetic construct
  source 1..98: mol_type = other RNA
actggcgcttctatctgattactctgagcgccatcaccagcgactatgtcgtatgggtaaagccgcttacggacttcggtccgtaagaggcatcagag

SEQ ID NO: 1797 - RNA, 98 nt, synthetic construct
  source 1..98: mol_type = other RNA
actggcgcttctatctgattactctgagcgccatcaccagcgactatgtcgtatgggtaaagcgccttacggacttcggtccgtaaggagcatcagag

SEQ ID NO: 1798 - RNA, 98 nt, synthetic construct
  source 1..98: mol_type = other RNA
acgggactttctatctgattactctgaagtccctcaccagcgactatgtcgtatgggtaaagccgcttacggacttcggtccgtaagaggcatcagag

SEQ ID NO: 1799 - RNA, 98 nt, synthetic construct
  source 1..98: mol_type = other RNA
acctgtagttctatctgattactctgactacagtcaccagcgactatgtcgtatgggtaaagccgcttacggacttcggtccgtaagaggcatcagag

SEQ ID NO: 1800 - RNA, 99 nt, synthetic construct
  source 1..99: mol_type = other RNA
actgggccttctatctgattactctgaggcccatcaccagcgactatgtcgtagtgggtaaagccgcttagggacttcggtccctaagaggcatcagag

SEQ ID NO: 1801 - RNA, 97 nt, synthetic construct
  source 1..97: mol_type = other RNA
actgggccttctatctgattactctgaggcccatcaccagcgactatgtcgtagtgggtaaagcccttagggacttcggtccctaagggcatcagag

SEQ ID NO: 1802 - RNA, 99 nt, synthetic construct
  source 1..99: mol_type = other RNA
actgggccttctatctgattactctgaggcccatcaccagcgactatgtcgtagtgggtaaagcctcttagggacttcggtccctaagaggcatcagag

SEQ ID NO: 1803 - RNA, 89 nt, synthetic construct
  source 1..89: mol_type = other RNA
actgggccttctatctgattactctgaggcccatcaccagcgactatgtcgtagtgggtaaagctccctcttcggagggagcatcagag

SEQ ID NO: 1804 - RNA, 97 nt, synthetic construct
  source 1..97: mol_type = other RNA
actgggccttctatctgattactctgaggcccatcaccagcgactatgtcgtagtgggtaaagcccttagggaccttggtccctaagggcatcagag

SEQ ID NO: 1805 - RNA, 99 nt, synthetic construct
  source 1..99: mol_type = other RNA
actgggccttctatctgattactctgaggcccatcaccagcgactatgtcgtagtgggtaaagcctcttagggaccttggtccctaagaggcatcagag

SEQ ID NO: 1806 - RNA, 89 nt, synthetic construct
  source 1..89: mol_type = other RNA
actgggccttctatctgattactctgaggcccatcaccagcgactatgtcgtagtgggtaaagctccctccttggagggagcatcagag

SEQ ID NO: 1807 - RNA, 97 nt, synthetic construct
  source 1..97: mol_type = other RNA
actgggccttctatctgattactctgaggcccatcaccagcgactatgtcgtagtgggtaaagcccttagggaggaaactccctaagggcatcagag

SEQ ID NO: 1808 - RNA, 99 nt, synthetic construct
  source 1..99: mol_type = other RNA
actgggccttctatctgattactctgaggcccatcaccagcgactatgtcgtagtgggtaaagcctcttagggaggaaactccctaagaggcatcagag

SEQ ID NO: 1809 - RNA, 89 nt, synthetic construct
  source 1..89: mol_type = other RNA
actgggccttctatctgattactctgaggcccatcaccagcgactatgtcgtagtgggtaaagctccctggaaacagggagcatcagag

SEQ ID NO: 1810 - RNA, 98 nt, synthetic construct
  source 1..98: mol_type = other RNA
actgggccttctatctgattactctgaggcccatcaccagcgactatgtcgtagtgggtaaagcccttagggacttcaggtccctaagggcatcagag

SEQ ID NO: 1811 - RNA, 100 nt, synthetic construct
  source 1..100: mol_type = other RNA
actgggccttctatctgattactctgaggcccatcaccagcgactatgtcgtagtgggtaaagcctcttagggacttcaggtccctaagaggcatcagag

SEQ ID NO: 1812 - RNA, 90 nt, synthetic construct
  source 1..90: mol_type = other RNA
actgggccttctatctgattactctgaggcccatcaccagcgactatgtcgtagtgggtaaagctccctcttcaggagggagcatcagag

SEQ ID NO: 1813 - RNA, 97 nt, synthetic construct
  source 1..97: mol_type = other RNA
actgggccttctatctgattactctgaggcccatcaccaggcactatgtgctagtgggtaaagcccttagggaccttggtccctaagggcatcagag

SEQ ID NO: 1814 - RNA, 99 nt, synthetic construct
  source 1..99: mol_type = other RNA
actgggccttctatctgattactctgaggcccatcaccaggcactatgtgctagtgggtaaagcctcttagggaccttggtccctaagaggcatcagag

SEQ ID NO: 1815 - RNA, 89 nt, synthetic construct
  source 1..89: mol_type = other RNA
actgggccttctatctgattactctgaggcccatcaccaggcactatgtgctagtgggtaaagctccctccttggagggagcatcagag

SEQ ID NO: 1816 - RNA, 97 nt, synthetic construct
  source 1..97: mol_type = other RNA
actgggccttctatctgattactctgaggcccatcaccaggcactatgtgctagtgggtaaagcccttagggaggaaactccctaagggcatcagag

SEQ ID NO: 1817 - RNA, 99 nt, synthetic construct
  source 1..99: mol_type = other RNA
actgggccttctatctgattactctgaggcccatcaccaggcactatgtgctagtgggtaaagcctcttagggaggaaactccctaagaggcatcagag

SEQ ID NO: 1818 - RNA, 89 nt, synthetic construct
  source 1..89: mol_type = other RNA
actgggccttctatctgattactctgaggcccatcaccaggcactatgtgctagtgggtaaagctccctggaaacagggagcatcagag

SEQ ID NO: 1819 - RNA, 98 nt, synthetic construct
  source 1..98: mol_type = other RNA
actgggccttctatctgattactctgaggcccatcaccaggcactatgtgctagtgggtaaagcccttagggacttcaggtccctaagggcatcagag

SEQ ID NO: 1820 - RNA, 100 nt, synthetic construct
  source 1..100: mol_type = other RNA
actgggccttctatctgattactctgaggcccatcaccaggcactatgtgctagtgggtaaagcctcttagggacttcaggtccctaagaggcatcagag

SEQ ID NO: 1821 - RNA, 90 nt, synthetic construct
  source 1..90: mol_type = other RNA
actgggccttctatctgattactctgaggcccatcaccaggcactatgtgctagtgggtaaagctccctcttcaggagggagcatcagag

SEQ ID NO: 1822 - RNA, 21 nt, synthetic construct
  source 1..21: mol_type = other RNA
ccagcgactatgtcgtagtgg

SEQ ID NO: 1823 - protein, 692 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 1824 - RNA, 20 nt, synthetic construct
  source 1..20: mol_type = other RNA
aattacaggcaacaggaagg

SEQ ID NO: 1825 - RNA, 20 nt, synthetic construct
  source 1..20: mol_type = other RNA
ccccatgtaagagaggaagt

SEQ ID NO: 1826 - RNA, 20 nt, synthetic construct
  source 1..20: mol_type = other RNA
cagtttctgcctcgccgcgg

SEQ ID NO: 1827 - RNA, 20 nt, synthetic construct
  source 1..20: mol_type = other RNA
gcctcgccgcggcacaggtg

SEQ ID NO: 1828 - RNA, 20 nt, synthetic construct
  source 1..20: mol_type = other RNA
cccacctgtgccgcggcgag

SEQ ID NO: 1829 - RNA, 20 nt, synthetic construct
  source 1..20: mol_type = other RNA
ctccttcacccacctgtgcc

SEQ ID NO: 1830 - RNA, 20 nt, synthetic construct
  source 1..20: mol_type = other RNA
aggcattcactccttcaccc

SEQ ID NO: 1831 - RNA, 20 nt, synthetic construct
  source 1..20: mol_type = other RNA
ctgtgcctggtgcagttccc

SEQ ID NO: 1832 - RNA, 20 nt, synthetic construct
  source 1..20: mol_type = other RNA
gtgtcataaagaaattgcct

SEQ ID NO: 1833 - RNA, 20 nt, synthetic construct
  source 1..20: mol_type = other RNA
ttatgacacagaactcatgc

SEQ ID NO: 1834 - RNA, 20 nt, synthetic construct
  source 1..20: mol_type = other RNA
gaggaggacggcctggccga

SEQ ID NO: 1835 - RNA, 20 nt, synthetic construct
  source 1..20: mol_type = other RNA
accgctgcgccaaggtgcgg

SEQ ID NO: 1836 - RNA, 20 nt, synthetic construct
  source 1..20: mol_type = other RNA
gccaggccgtcctcctcgga

SEQ ID NO: 1837 - RNA, 20 nt, synthetic construct
  source 1..20: mol_type = other RNA
gtgctcgggtgcttcggcca

SEQ ID NO: 1838 - RNA, 20 nt, synthetic construct
  source 1..20: mol_type = other RNA
actttgtttgcaaagacctc

SEQ ID NO: 1839 - RNA, 20 nt, synthetic construct
  source 1..20: mol_type = other RNA
gagtgaaatggcctgctctg

SEQ ID NO: 1840 - RNA, 20 nt, synthetic construct
  source 1..20: mol_type = other RNA
gagcaggccatttcactcgg

SEQ ID NO: 1841 - RNA, 20 nt, synthetic construct
  source 1..20: mol_type = other RNA
ctcggaatctgctgtgcatc

SEQ ID NO: 1842 - RNA, 20 nt, synthetic construct
  source 1..20: mol_type = other RNA
ggaagggctgtcgatactgg

SEQ ID NO: 1843 - RNA, 20 nt, synthetic construct
  source 1..20: mol_type = other RNA
tcccagtatcgacagccctt

SEQ ID NO: 1844 - RNA, 20 nt, synthetic construct
  source 1..20: mol_type = other RNA
cagtatcgacagcccttcca

SEQ ID NO: 1845 - RNA, 20 nt, synthetic construct
  source 1..20: mol_type = other RNA
agaaagagcaagcctcatgt

SEQ ID NO: 1846 - RNA, 20 nt, synthetic construct
  source 1..20: mol_type = other RNA
agaaatcaactggacaagca

SEQ ID NO: 1847 - RNA, 20 nt, synthetic construct
  source 1..20: mol_type = other RNA
tgaacatggtgtgtaaaagg

SEQ ID NO: 1848 - RNA, 20 nt, synthetic construct
  source 1..20: mol_type = other RNA
agaagattcaatttgcaaag

SEQ ID NO: 1849 - RNA, 20 nt, synthetic construct
  source 1..20: mol_type = other RNA
atggtaggcacaagctcagc

SEQ ID NO: 1850 - RNA, 20 nt, synthetic construct
  source 1..20: mol_type = other RNA
gaattctatggtaggcacaa

SEQ ID NO: 1851 - RNA, 20 nt, synthetic construct
  source 1..20: mol_type = other RNA
ggaaagctgagcttgtgcct

SEQ ID NO: 1852 - RNA, 20 nt, synthetic construct
  source 1..20: mol_type = other RNA
agggatttatactacaaaga

SEQ ID NO: 1853 - RNA, 20 nt, synthetic construct
  source 1..20: mol_type = other RNA
aggagcagctagttggtaag

SEQ ID NO: 1854 - RNA, 20 nt, synthetic construct
  source 1..20: mol_type = other RNA
aaacttagcctggaccccct

SEQ ID NO: 1855 - RNA, 20 nt, synthetic construct
  source 1..20: mol_type = other RNA
actggccttaacctggcagc

SEQ ID NO: 1856 - RNA, 20 nt, synthetic construct
  source 1..20: mol_type = other RNA
ttccactggccttaacctgg

SEQ ID NO: 1857 - RNA, 20 nt, synthetic construct
  source 1..20: mol_type = other RNA
gaatcaatcctactgtggac

SEQ ID NO: 1858 - RNA, 20 nt, synthetic construct
  source 1..20: mol_type = other RNA
gtgggcagcgaggagtccac

SEQ ID NO: 1859 - RNA, 20 nt, synthetic construct
  source 1..20: mol_type = other RNA
tgggtccaccttgtctcctg

SEQ ID NO: 1860 - RNA, 20 nt, synthetic construct
  source 1..20: mol_type = other RNA
gaagtctcactggtcagcag

SEQ ID NO: 1861 - RNA, 20 nt, synthetic construct
  source 1..20: mol_type = other RNA
gtgtttcctgggtccacctt

SEQ ID NO: 1862 - RNA, 20 nt, synthetic construct
  source 1..20: mol_type = other RNA
agcccagttaggatttggga

SEQ ID NO: 1863 - RNA, 20 nt, synthetic construct
  source 1..20: mol_type = other RNA
tccctctgcgcgtaatctga

SEQ ID NO: 1864 - RNA, 20 nt, synthetic construct
  source 1..20: mol_type = other RNA
ctctgcgcgtaatctgacgc

SEQ ID NO: 1865 - RNA, 20 nt, synthetic construct
  source 1..20: mol_type = other RNA
gcctcgccctccccaaacag

SEQ ID NO: 1866 - RNA, 20 nt, synthetic construct
  source 1..20: mol_type = other RNA
gttaatgtttaatcagatag

SEQ ID NO: 1867 - RNA, 20 nt, synthetic construct
  source 1..20: mol_type = other RNA
agggtgtgggtgcttgacgc

SEQ ID NO: 1868 - RNA, 20 nt, synthetic construct
  source 1..20: mol_type = other RNA
gcagcgacgtcgaggcgctc

SEQ ID NO: 1869 - RNA, 20 nt, synthetic construct
  source 1..20: mol_type = other RNA
gggtctgagcctggaggagt

SEQ ID NO: 1870 - RNA, 20 nt, synthetic construct
  source 1..20: mol_type = other RNA
ggagcagggcgcgtgaaggg

SEQ ID NO: 1871 - RNA, 20 nt, synthetic construct
  source 1..20: mol_type = other RNA
gcgcgccccttcacgcgccc

SEQ ID NO: 1872 - RNA, 20 nt, synthetic construct
  source 1..20: mol_type = other RNA
cgcgccctgctcctgaactt

SEQ ID NO: 1873 - RNA, 20 nt, synthetic construct
  source 1..20: mol_type = other RNA
gctcctgcacagtcctcccc

SEQ ID NO: 1874 - RNA, 20 nt, synthetic construct
  source 1..20: mol_type = other RNA
cactgaatagcgcagccgca

SEQ ID NO: 1875 - RNA, 20 nt, synthetic construct
  source 1..20: mol_type = other RNA
gtgggaaggttcgcggggtt

SEQ ID NO: 1876 - RNA, 20 nt, synthetic construct
  source 1..20: mol_type = other RNA
cggggttgggagacccggag

SEQ ID NO: 1877 - RNA, 20 nt, synthetic construct
  source 1..20: mol_type = other RNA
tcggcctccgggtctcccaa

SEQ ID NO: 1878 - RNA, 20 nt, synthetic construct
  source 1..20: mol_type = other RNA
cagtacgttccaggcattca

SEQ ID NO: 1879 - RNA, 20 nt, synthetic construct
  source 1..20: mol_type = other RNA
gctgaaacagatggaatact

SEQ ID NO: 1880 - RNA, 20 nt, synthetic construct
  source 1..20: mol_type = other RNA
aaaccaaatcggaacccact

SEQ ID NO: 1881 - RNA, 20 nt, synthetic construct
  source 1..20: mol_type = other RNA
tgttgcctgtaattggaatt

SEQ ID NO: 1882 - RNA, 20 nt, synthetic construct
  source 1..20: mol_type = other RNA
ccttcctgttgcctgtaatt

SEQ ID NO: 1883 - RNA, 20 nt, synthetic construct
  source 1..20: mol_type = other RNA
cctttgtttcttcccagtat

SEQ ID NO: 1884 - RNA, 20 nt, synthetic construct
  source 1..20: mol_type = other RNA
tcctcctgcctggtacacaa

SEQ ID NO: 1885 - RNA, 20 nt, synthetic construct
  source 1..20: mol_type = other RNA
gaatgtacctatatgacgtc

SEQ ID NO: 1886 - RNA, 20 nt, synthetic construct
  source 1..20: mol_type = other RNA
ccccggcctcccatccctac

SEQ ID NO: 1887 - RNA, 20 nt, synthetic construct
  source 1..20: mol_type = other RNA
cttggcacgatcttggggac

SEQ ID NO: 1888 - RNA, 20 nt, synthetic construct
  source 1..20: mol_type = other RNA
gatttggtttggaaaacatg

SEQ ID NO: 1889 - RNA, 20 nt, synthetic construct
  source 1..20: mol_type = other RNA
ctccaggccctccaccctcc

SEQ ID NO: 1890 - RNA, 20 nt, synthetic construct
  source 1..20: mol_type = other RNA
caccccgcccctgtctcggg

SEQ ID NO: 1891 - RNA, 20 nt, synthetic construct
  source 1..20: mol_type = other RNA
ccaacctcagaaacttggag

SEQ ID NO: 1892 - RNA, 20 nt, synthetic construct
  source 1..20: mol_type = other RNA
gaggttggagaaggtagcca

SEQ ID NO: 1893 - RNA, 20 nt, synthetic construct
  source 1..20: mol_type = other RNA
atctactcattcagtctatg

SEQ ID NO: 1894 - RNA, 20 nt, synthetic construct
  source 1..20: mol_type = other RNA
cctcatagactgaatgagta

SEQ ID NO: 1895 - RNA, 20 nt, synthetic construct
  source 1..20: mol_type = other RNA
gtctatgaggggaaggcaat

SEQ ID NO: 1896 - RNA, 20 nt, synthetic construct
  source 1..20: mol_type = other RNA
agccattgccttcccctcat

SEQ ID NO: 1897 - RNA, 20 nt, synthetic construct
  source 1..20: mol_type = other RNA
tccctctaaaaatgccactt

SEQ ID NO: 1898 - RNA, 20 nt, synthetic construct
  source 1..20: mol_type = other RNA
ccccacaagcatcctcaagg

SEQ ID NO: 1899 - RNA, 20 nt, synthetic construct
  source 1..20: mol_type = other RNA
cttcaccccacaagcatcct

SEQ ID NO: 1900 - RNA, 20 nt, synthetic construct
  source 1..20: mol_type = other RNA
tgagttattctttcccttca

SEQ ID NO: 1901 - RNA, 20 nt, synthetic construct
  source 1..20: mol_type = other RNA
gggcagaggggaccatcctc

SEQ ID NO: 1902 - RNA, 20 nt, synthetic construct
  source 1..20: mol_type = other RNA
tccttcagggcagaggggac

SEQ ID NO: 1903 - RNA, 20 nt, synthetic construct
  source 1..20: mol_type = other RNA
cctcctgccttcctccttca

SEQ ID NO: 1904 - RNA, 20 nt, synthetic construct
  source 1..20: mol_type = other RNA
ggggcctcccctccaccaca

SEQ ID NO: 1905 - RNA, 20 nt, synthetic construct
  source 1..20: mol_type = other RNA
gacttaccctgattgctggt

SEQ ID NO: 1906 - RNA, 20 nt, synthetic construct
  source 1..20: mol_type = other RNA
cccacaccctggccagcaaa

SEQ ID NO: 1907 - RNA, 20 nt, synthetic construct
  source 1..20: mol_type = other RNA
caaatgggttcccccacacc

SEQ ID NO: 1908 - RNA, 20 nt, synthetic construct
  source 1..20: mol_type = other RNA
ccctcttctcaaatgggttc

SEQ ID NO: 1909 - RNA, 20 nt, synthetic construct
  source 1..20: mol_type = other RNA
tttgggcaacttatgggagg

SEQ ID NO: 1910 - RNA, 20 nt, synthetic construct
  source 1..20: mol_type = other RNA
tccctcaccaattacccctc

SEQ ID NO: 1911 - RNA, 20 nt, synthetic construct
  source 1..20: mol_type = other RNA
catcccatatcctccactgc

SEQ ID NO: 1912 - RNA, 20 nt, synthetic construct
  source 1..20: mol_type = other RNA
atctgtcgcagagcccaggg

SEQ ID NO: 1913 - RNA, 20 nt, synthetic construct
  source 1..20: mol_type = other RNA
gagggaggtgggggaggaag

SEQ ID NO: 1914 - RNA, 20 nt, synthetic construct
  source 1..20: mol_type = other RNA
tcccccacctccctcagaac

SEQ ID NO: 1915 - RNA, 20 nt, synthetic construct
  source 1..20: mol_type = other RNA
tgggcctggggacatccatg

SEQ ID NO: 1916 - RNA, 20 nt, synthetic construct
  source 1..20: mol_type = other RNA
tcattctctgggtgcacggt

SEQ ID NO: 1917 - RNA, 20 nt, synthetic construct
  source 1..20: mol_type = other RNA
ctgggtgcacggtaacgacc

SEQ ID NO: 1918 - RNA, 20 nt, synthetic construct
  source 1..20: mol_type = other RNA
ctgctgctcccctttgggac

SEQ ID NO: 1919 - RNA, 20 nt, synthetic construct
  source 1..20: mol_type = other RNA
tgctccaggggaggcctttg

SEQ ID NO: 1920 - RNA, 20 nt, synthetic construct
  source 1..20: mol_type = other RNA
tcatcaaaggcctcccctgg

SEQ ID NO: 1921 - RNA, 20 nt, synthetic construct
  source 1..20: mol_type = other RNA
tcggctgaaacagatggaat

SEQ ID NO: 1922 - RNA, 20 nt, synthetic construct
  source 1..20: mol_type = other RNA
atctgtttcagccgaagaaa

SEQ ID NO: 1923 - RNA, 20 nt, synthetic construct
  source 1..20: mol_type = other RNA
tttcttcggctgaaacagat

SEQ ID NO: 1924 - RNA, 20 nt, synthetic construct
  source 1..20: mol_type = other RNA
gccgaagaaaagaaccagct

SEQ ID NO: 1925 - RNA, 20 nt, synthetic construct
  source 1..20: mol_type = other RNA
cccctgccccttcagctggt

SEQ ID NO: 1926 - RNA, 20 nt, synthetic construct
  source 1..20: mol_type = other RNA
cgaggcccattggcgtcctt

SEQ ID NO: 1927 - RNA, 20 nt, synthetic construct
  source 1..20: mol_type = other RNA
ctgcctgagtcctaaaggac

SEQ ID NO: 1928 - RNA, 20 nt, synthetic construct
  source 1..20: mol_type = other RNA
cacagcctgagggccagaag

SEQ ID NO: 1929 - RNA, 20 nt, synthetic construct
  source 1..20: mol_type = other RNA
ggccctcaggctgtgggaag

SEQ ID NO: 1930 - RNA, 20 nt, synthetic construct
  source 1..20: mol_type = other RNA
tcccggggcgagaccactag

SEQ ID NO: 1931 - RNA, 20 nt, synthetic construct
  source 1..20: mol_type = other RNA
cggggcgagaccactagctt

SEQ ID NO: 1932 - RNA, 20 nt, synthetic construct
  source 1..20: mol_type = other RNA
aagtattaccagcccaggac

SEQ ID NO: 1933 - RNA, 20 nt, synthetic construct
  source 1..20: mol_type = other RNA
gtgtcccccagcttggagtc

SEQ ID NO: 1934 - RNA, 20 nt, synthetic construct
  source 1..20: mol_type = other RNA
tctcactagctgtggtgctt

SEQ ID NO: 1935 - RNA, 20 nt, synthetic construct
  source 1..20: mol_type = other RNA
tctccccatctgctgccact

SEQ ID NO: 1936 - RNA, 20 nt, synthetic construct
  source 1..20: mol_type = other RNA
cttcatctccccatctgctg

SEQ ID NO: 1937 - RNA, 20 nt, synthetic construct
  source 1..20: mol_type = other RNA
ctcatggtcaacagaacttt

SEQ ID NO: 1938 - RNA, 20 nt, synthetic construct
  source 1..20: mol_type = other RNA
gttgaccatgagtgaactta

SEQ ID NO: 1939 - RNA, 20 nt, synthetic construct
  source 1..20: mol_type = other RNA
cctctgccccaggagctgtg

SEQ ID NO: 1940 - RNA, 20 nt, synthetic construct
  source 1..20: mol_type = other RNA
gccactcacagctgcctgcc

SEQ ID NO: 1941 - RNA, 20 nt, synthetic construct
  source 1..20: mol_type = other RNA
gtctgagtgtgctgggtggc

SEQ ID NO: 1942 - RNA, 20 nt, synthetic construct
  source 1..20: mol_type = other RNA
ttgttccctgagcctttgac

SEQ ID NO: 1943 - RNA, 20 nt, synthetic construct
  source 1..20: mol_type = other RNA
ctgagcctttgactttctcg

SEQ ID NO: 1944 - RNA, 20 nt, synthetic construct
  source 1..20: mol_type = other RNA
cgagggatgttgtggggttg

SEQ ID NO: 1945 - RNA, 20 nt, synthetic construct
  source 1..20: mol_type = other RNA
tatcctggccacaaccccac

SEQ ID NO: 1946 - RNA, 20 nt, synthetic construct
  source 1..20: mol_type = other RNA
agttaccactgctccaaaac

SEQ ID NO: 1947 - RNA, 20 nt, synthetic construct
  source 1..20: mol_type = other RNA
ggaaatagtgagtaccccat

SEQ ID NO: 1948 - RNA, 20 nt, synthetic construct
  source 1..20: mol_type = other RNA
ggtggtcatacagcctctgc

SEQ ID NO: 1949 - RNA, 20 nt, synthetic construct
  source 1..20: mol_type = other RNA
accagagaagaaacatcctc

SEQ ID NO: 1950 - RNA, 20 nt, synthetic construct
  source 1..20: mol_type = other RNA
aaacttccaccagagaagaa

SEQ ID NO: 1951 - RNA, 20 nt, synthetic construct
  source 1..20: mol_type = other RNA
tctctggtggaagtttggaa

SEQ ID NO: 1952 - RNA, 20 nt, synthetic construct
  source 1..20: mol_type = other RNA
ctggtggaagtttggaacag

SEQ ID NO: 1953 - RNA, 20 nt, synthetic construct
  source 1..20: mol_type = other RNA
cacaaaataaccattgaatg

SEQ ID NO: 1954 - RNA, 20 nt, synthetic construct
  source 1..20: mol_type = other RNA
attcccacaaaataaccatt

SEQ ID NO: 1955 - RNA, 20 nt, synthetic construct
  source 1..20: mol_type = other RNA
aaattcgattcccacaaaat

SEQ ID NO: 1956 - RNA, 20 nt, synthetic construct
  source 1..20: mol_type = other RNA
ttctaaattcgattcccaca

SEQ ID NO: 1957 - RNA, 20 nt, synthetic construct
  source 1..20: mol_type = other RNA
catgactaaaagaaaaggat

SEQ ID NO: 1958 - RNA, 20 nt, synthetic construct
  source 1..20: mol_type = other RNA
tttagtcatgagaaactgag

SEQ ID NO: 1959 - RNA, 20 nt, synthetic construct
  source 1..20: mol_type = other RNA
aatgcacctggggtgacctc

SEQ ID NO: 1960 - RNA, 20 nt, synthetic construct
  source 1..20: mol_type = other RNA
ggaaacccagttctaatgca

SEQ ID NO: 1961 - RNA, 20 nt, synthetic construct
  source 1..20: mol_type = other RNA
agaactgacactccactgca

SEQ ID NO: 1962 - RNA, 20 nt, synthetic construct
  source 1..20: mol_type = other RNA
aagacccatctgaaaatgcc

SEQ ID NO: 1963 - RNA, 20 nt, synthetic construct
  source 1..20: mol_type = other RNA
gatgggtctttgaagcatta

SEQ ID NO: 1964 - RNA, 20 nt, synthetic construct
  source 1..20: mol_type = other RNA
catgacaccatcatcgctga

SEQ ID NO: 1965 - RNA, 20 nt, synthetic construct
  source 1..20: mol_type = other RNA
gcgatgatggtgtcatgaga

SEQ ID NO: 1966 - RNA, 20 nt, synthetic construct
  source 1..20: mol_type = other RNA
tggtacctcctaatcctaga

SEQ ID NO: 1967 - RNA, 20 nt, synthetic construct
  source 1..20: mol_type = other RNA
aggattaggaggtaccatga

SEQ ID NO: 1968 - RNA, 20 nt, synthetic construct
  source 1..20: mol_type = other RNA
cagctctgtatctttgttca

SEQ ID NO: 1969 - RNA, 20 nt, synthetic construct
  source 1..20: mol_type = other RNA
gacggtggataaagaactgt

SEQ ID NO: 1970 - RNA, 20 nt, synthetic construct
  source 1..20: mol_type = other RNA
ttatccaccgtctgaaatgt

SEQ ID NO: 1971 - RNA, 20 nt, synthetic construct
  source 1..20: mol_type = other RNA
cgtcaggtgctaccatcaaa

SEQ ID NO: 1972 - RNA, 20 nt, synthetic construct
  source 1..20: mol_type = other RNA
tccaagcagactctgattgc

SEQ ID NO: 1973 - RNA, 20 nt, synthetic construct
  source 1..20: mol_type = other RNA
aagcagactctgattgccca

SEQ ID NO: 1974 - RNA, 20 nt, synthetic construct
  source 1..20: mol_type = other RNA
aaaatccaaacaagttctga

SEQ ID NO: 1975 - RNA, 20 nt, synthetic construct
  source 1..20: mol_type = other RNA
actctgactggagtccaaga

SEQ ID NO: 1976 - RNA, 20 nt, synthetic construct
  source 1..20: mol_type = other RNA
ctggctccccacagcctcat

SEQ ID NO: 1977 - RNA, 20 nt, synthetic construct
  source 1..20: mol_type = other RNA
tgaggctgtggggagccagt

SEQ ID NO: 1978 - RNA, 20 nt, synthetic construct
  source 1..20: mol_type = other RNA
taagcaggtatgtctgcctg

SEQ ID NO: 1979 - RNA, 20 nt, synthetic construct
  source 1..20: mol_type = other RNA
caggggttcctcccccatga

SEQ ID NO: 1980 - RNA, 20 nt, synthetic construct
  source 1..20: mol_type = other RNA
agggaaatcatagcgggaga

SEQ ID NO: 1981 - RNA, 20 nt, synthetic construct
  source 1..20: mol_type = other RNA
cccgctatgatttcccttga

SEQ ID NO: 1982 - RNA, 20 nt, synthetic construct
  source 1..20: mol_type = other RNA
cttgaaggctgattattaaa

SEQ ID NO: 1983 - RNA, 20 nt, synthetic construct
  source 1..20: mol_type = other RNA
cttgccatgtgattgatctc

SEQ ID NO: 1984 - RNA, 20 nt, synthetic construct
  source 1..20: mol_type = other RNA
gccatcagtgaaagcagctt

SEQ ID NO: 1985 - RNA, 20 nt, synthetic construct
  source 1..20: mol_type = other RNA
tggagagcttgcagaatcat

SEQ ID NO: 1986 - RNA, 20 nt, synthetic construct
  source 1..20: mol_type = other RNA
gctcatgattctgcaagctc

SEQ ID NO: 1987 - RNA, 20 nt, synthetic construct
  source 1..20: mol_type = other RNA
tttatatagcaacacaaaag

SEQ ID NO: 1988 - RNA, 20 nt, synthetic construct
  source 1..20: mol_type = other RNA
taaagagagagaaaagtcaa

SEQ ID NO: 1989 - RNA, 20 nt, synthetic construct
  source 1..20: mol_type = other RNA
ctctctttaagaagtgttgc

SEQ ID NO: 1990 - RNA, 20 nt, synthetic construct
  source 1..20: mol_type = other RNA
gcctgcatttgtagagcatc

SEQ ID NO: 1991 - RNA, 20 nt, synthetic construct
  source 1..20: mol_type = other RNA
cagcaggcctatgtcatagg

SEQ ID NO: 1992 - RNA, 20 nt, synthetic construct
  source 1..20: mol_type = other RNA
agctccaatatttactggtt

SEQ ID NO: 1993 - RNA, 20 nt, synthetic construct
  source 1..20: mol_type = other RNA
ggtccacggtttcctggctc

SEQ ID NO: 1994 - RNA, 20 nt, synthetic construct
  source 1..20: mol_type = other RNA
tggctccaaagcccatgatt

SEQ ID NO: 1995 - RNA, 20 nt, synthetic construct
  source 1..20: mol_type = other RNA
ctcaatttattctgactggg

SEQ ID NO: 1996 - RNA, 20 nt, synthetic construct
  source 1..20: mol_type = other RNA
gactggggcatgggggaggg

SEQ ID NO: 1997 - RNA, 20 nt, synthetic construct
  source 1..20: mol_type = other RNA
tctgtacctgcacccagctc

SEQ ID NO: 1998 - RNA, 20 nt, synthetic construct
  source 1..20: mol_type = other RNA
ggcaaaaatgggaactacgg

SEQ ID NO: 1999 - RNA, 20 nt, synthetic construct
  source 1..20: mol_type = other RNA
aatgtgccattcaggcaaaa

SEQ ID NO: 2000 - RNA, 20 nt, synthetic construct
  source 1..20: mol_type = other RNA
catggttatataacactttc

SEQ ID NO: 2001 - RNA, 20 nt, synthetic construct
  source 1..20: mol_type = other RNA
ttatcatctactatactctg

SEQ ID NO: 2002 - RNA, 20 nt, synthetic construct
  source 1..20: mol_type = other RNA
tccatgtcatcatgttcctc

SEQ ID NO: 2003 - RNA, 20 nt, synthetic construct
  source 1..20: mol_type = other RNA
atgtcatcatgttcctcctt

SEQ ID NO: 2004 - RNA, 20 nt, synthetic construct
  source 1..20: mol_type = other RNA
tccttgcatggggccaggat

SEQ ID NO: 2005 - RNA, 20 nt, synthetic construct
  source 1..20: mol_type = other RNA
gcaccaccacgtaggtgcca

SEQ ID NO: 2006 - RNA, 20 nt, synthetic construct
  source 1..20: mol_type = other RNA
atggccttcttcctggcttc

SEQ ID NO: 2007 - RNA, 20 nt, synthetic construct
  source 1..20: mol_type = other RNA
ccaggaagccaggaagaagg

SEQ ID NO: 2008 - RNA, 20 nt, synthetic construct
  source 1..20: mol_type = other RNA
tcctggcttcctggtgaaga

SEQ ID NO: 2009 - RNA, 20 nt, synthetic construct
  source 1..20: mol_type = other RNA
tggcttcctggtgaagatga

SEQ ID NO: 2010 - RNA, 20 nt, synthetic construct
  source 1..20: mol_type = other RNA
tggtgaagatgagtggcgac

SEQ ID NO: 2011 - RNA, 20 nt, synthetic construct
  source 1..20: mol_type = other RNA
caaaaagggtggctcaccag

SEQ ID NO: 2012 - RNA, 20 nt, synthetic construct
  source 1..20: mol_type = other RNA
tgatagggctgggccactgc

SEQ ID NO: 2013 - RNA, 20 nt, synthetic construct
  source 1..20: mol_type = other RNA
gcaatgggcctactaagcac

SEQ ID NO: 2014 - RNA, 20 nt, synthetic construct
  source 1..20: mol_type = other RNA
atacagaaagccagtagtta

SEQ ID NO: 2015 - RNA, 20 nt, synthetic construct
  source 1..20: mol_type = other RNA
gtatagaattccctttaagc

SEQ ID NO: 2016 - RNA, 20 nt, synthetic construct
  source 1..20: mol_type = other RNA
ctttaagcctggccatgccc

SEQ ID NO: 2017 - RNA, 20 nt, synthetic construct
  source 1..20: mol_type = other RNA
aatgaagatagacgtaccac

SEQ ID NO: 2018 - RNA, 20 nt, synthetic construct
  source 1..20: mol_type = other RNA
gtctcctcgtctttcaaatg

SEQ ID NO: 2019 - RNA, 20 nt, synthetic construct
  source 1..20: mol_type = other RNA
tttgaaagacgaggagactg

SEQ ID NO: 2020 - RNA, 20 nt, synthetic construct
  source 1..20: mol_type = other RNA
gaggggaccacacagacagc

SEQ ID NO: 2021 - RNA, 20 nt, synthetic construct
  source 1..20: mol_type = other RNA
tgtgccaatgcatctgctgc

SEQ ID NO: 2022 - RNA, 20 nt, synthetic construct
  source 1..20: mol_type = other RNA
gtaggcagcagatgcattgg

SEQ ID NO: 2023 - RNA, 20 nt, synthetic construct
  source 1..20: mol_type = other RNA
tttgaagctgttgctatcca

SEQ ID NO: 2024 - RNA, 20 nt, synthetic construct
  source 1..20: mol_type = other RNA
ctctggatagcaacagcttc

SEQ ID NO: 2025 - RNA, 20 nt, synthetic construct
  source 1..20: mol_type = other RNA
ttaggacagggtggccctcc

SEQ ID NO: 2026 - RNA, 20 nt, synthetic construct
  source 1..20: mol_type = other RNA
gcccctccaccgaagatgtg

SEQ ID NO: 2027 - RNA, 20 nt, synthetic construct
  source 1..20: mol_type = other RNA
gtggaggggcagaaagggga

SEQ ID NO: 2028 - RNA, 20 nt, synthetic construct
  source 1..20: mol_type = other RNA
cctcaccctggccctagtgc

SEQ ID NO: 2029 - RNA, 20 nt, synthetic construct
  source 1..20: mol_type = other RNA
gcaccaccttctagcccacc

SEQ ID NO: 2030 - RNA, 20 nt, synthetic construct
  source 1..20: mol_type = other RNA
agcccacctcgtttcctggc

SEQ ID NO: 2031 - RNA, 20 nt, synthetic construct
  source 1..20: mol_type = other RNA
tggcctctaacttgatgaga

SEQ ID NO: 2032 - RNA, 20 nt, synthetic construct
  source 1..20: mol_type = other RNA
cactgattctccacatggca

SEQ ID NO: 2033 - RNA, 20 nt, synthetic construct
  source 1..20: mol_type = other RNA
ccacatggcaggcggtgctt

SEQ ID NO: 2034 - RNA, 20 nt, synthetic construct
  source 1..20: mol_type = other RNA
tagcctcctgcagacagtga

SEQ ID NO: 2035 - RNA, 20 nt, synthetic construct
  source 1..20: mol_type = other RNA
gccacggtatgctgagctga

SEQ ID NO: 2036 - RNA, 20 nt, synthetic construct
  source 1..20: mol_type = other RNA
aaggcagggaccctgtcaat

SEQ ID NO: 2037 - RNA, 20 nt, synthetic construct
  source 1..20: mol_type = other RNA
atcagtctgctcaacacacg

SEQ ID NO: 2038 - RNA, 20 nt, synthetic construct
  source 1..20: mol_type = other RNA
cctctgcagcacacagtagg

SEQ ID NO: 2039 - RNA, 20 nt, synthetic construct
  source 1..20: mol_type = other RNA
cttgagcttacagttcagga

SEQ ID NO: 2040 - RNA, 20 nt, synthetic construct
  source 1..20: mol_type = other RNA
ggaggagagactgaccagtg

SEQ ID NO: 2041 - RNA, 20 nt, synthetic construct
  source 1..20: mol_type = other RNA
tctctccccaaggctgagca

SEQ ID NO: 2042 - RNA, 20 nt, synthetic construct
  source 1..20: mol_type = other RNA
tcgtctctccccaaggctga

SEQ ID NO: 2043 - RNA, 20 nt, synthetic construct
  source 1..20: mol_type = other RNA
gcttggcctactctcctctg

SEQ ID NO: 2044 - RNA, 20 nt, synthetic construct
  source 1..20: mol_type = other RNA
gtttgccttctgcttggcct

SEQ ID NO: 2045 - RNA, 20 nt, synthetic construct
  source 1..20: mol_type = other RNA
aactgggcatcataccagcc

SEQ ID NO: 2046 - RNA, 20 nt, synthetic construct
  source 1..20: mol_type = other RNA
agtcctgcccagccccttat

SEQ ID NO: 2047 - RNA, 20 nt, synthetic construct
  source 1..20: mol_type = other RNA
tctatctgtaaaccagttat

SEQ ID NO: 2048 - RNA, 20 nt, synthetic construct
  source 1..20: mol_type = other RNA
tttaaggactaaatgaggtc

SEQ ID NO: 2049 - RNA, 20 nt, synthetic construct
  source 1..20: mol_type = other RNA
cgacctcatttagtccttaa

SEQ ID NO: 2050 - RNA, 20 nt, synthetic construct
  source 1..20: mol_type = other RNA
gtacctagcatctgctgaat

SEQ ID NO: 2051 - RNA, 20 nt, synthetic construct
  source 1..20: mol_type = other RNA
gcagatgctaggtacggaaa

SEQ ID NO: 2052 - RNA, 20 nt, synthetic construct
  source 1..20: mol_type = other RNA
gcgagtttccgtacctagca

SEQ ID NO: 2053 - RNA, 20 nt, synthetic construct
  source 1..20: mol_type = other RNA
taacctgcccccacttcagc

SEQ ID NO: 2054 - RNA, 20 nt, synthetic construct
  source 1..20: mol_type = other RNA
tatccccagaggcttcttaa

SEQ ID NO: 2055 - RNA, 20 nt, synthetic construct
  source 1..20: mol_type = other RNA
gacctaagtggtaacagcct

SEQ ID NO: 2056 - RNA, 20 nt, synthetic construct
  source 1..20: mol_type = other RNA
ctctccttacccttcagacc

SEQ ID NO: 2057 - RNA, 20 nt, synthetic construct
  source 1..20: mol_type = other RNA
ctctgcccagttggagccgg

SEQ ID NO: 2058 - RNA, 20 nt, synthetic construct
  source 1..20: mol_type = other RNA
ccacaggcagcctctcctcc

SEQ ID NO: 2059 - RNA, 20 nt, synthetic construct
  source 1..20: mol_type = other RNA
ccgctgccatgcgcagggag

SEQ ID NO: 2060 - RNA, 20 nt, synthetic construct
  source 1..20: mol_type = other RNA
ccagcctgctcagtgcaaac

SEQ ID NO: 2061 - RNA, 20 nt, synthetic construct
  source 1..20: mol_type = other RNA
gtttgtcccctagtctattc

SEQ ID NO: 2062 - RNA, 20 nt, synthetic construct
  source 1..20: mol_type = other RNA
ctccatgtccatcctgccca

SEQ ID NO: 2063 - RNA, 20 nt, synthetic construct
  source 1..20: mol_type = other RNA
gaacttgacatcttgtctgg

SEQ ID NO: 2064 - RNA, 20 nt, synthetic construct
  source 1..20: mol_type = other RNA
gaatccttcctaaaaggaat

SEQ ID NO: 2065 - RNA, 20 nt, synthetic construct
  source 1..20: mol_type = other RNA
taaaaggaatcctctatgcc

SEQ ID NO: 2066 - RNA, 20 nt, synthetic construct
  source 1..20: mol_type = other RNA
gcaggccttgaagttgcccc

SEQ ID NO: 2067 - RNA, 20 nt, synthetic construct
  source 1..20: mol_type = other RNA
acgggatgctctgggcaaag

SEQ ID NO: 2068 - RNA, 20 nt, synthetic construct
  source 1..20: mol_type = other RNA
tccgcccggtaccgtggagg

SEQ ID NO: 2069 - RNA, 20 nt, synthetic construct
  source 1..20: mol_type = other RNA
gctcagatggggtggggcag

SEQ ID NO: 2070 - RNA, 20 nt, synthetic construct
  source 1..20: mol_type = other RNA
tgttgccccacaaatgcaaa

SEQ ID NO: 2071 - RNA, 20 nt, synthetic construct
  source 1..20: mol_type = other RNA
aaatggtgagaaaaggaaaa

SEQ ID NO: 2072 - RNA, 20 nt, synthetic construct
  source 1..20: mol_type = other RNA
caccatttggaatggcccag

SEQ ID NO: 2073 - RNA, 20 nt, synthetic construct
  source 1..20: mol_type = other RNA
aaggtaagtgcagcctgctg

SEQ ID NO: 2074 - RNA, 20 nt, synthetic construct
  source 1..20: mol_type = other RNA
tctgatggtgactctaccta

SEQ ID NO: 2075 - RNA, 20 nt, synthetic construct
  source 1..20: mol_type = other RNA
tggggctccctgcctgggcc

SEQ ID NO: 2076 - RNA, 20 nt, synthetic construct
  source 1..20: mol_type = other RNA
ctctaggcctttctttccac

SEQ ID NO: 2077 - RNA, 20 nt, synthetic construct
  source 1..20: mol_type = other RNA
ttccactgttccctctgcct

SEQ ID NO: 2078 - RNA, 20 nt, synthetic construct
  source 1..20: mol_type = other RNA
ctctgcctggtgtggcctgg

SEQ ID NO: 2079 - RNA, 20 nt, synthetic construct
  source 1..20: mol_type = other RNA
atagccaggccacaccaggc

SEQ ID NO: 2080 - RNA, 20 nt, synthetic construct
  source 1..20: mol_type = other RNA
atggccgctcctcctccctc

SEQ ID NO: 2081 - RNA, 20 nt, synthetic construct
  source 1..20: mol_type = other RNA
agcagggacttgcaggtggc

SEQ ID NO: 2082 - RNA, 20 nt, synthetic construct
  source 1..20: mol_type = other RNA
ccgactgaattgccacctgc

SEQ ID NO: 2083 - RNA, 20 nt, synthetic construct
  source 1..20: mol_type = other RNA
gtcggggaagactctagatg

SEQ ID NO: 2084 - RNA, 20 nt, synthetic construct
  source 1..20: mol_type = other RNA
ctcctcaggccaggtgcatc

SEQ ID NO: 2085 - RNA, 20 nt, synthetic construct
  source 1..20: mol_type = other RNA
ttctctcctcaggccaggtg

SEQ ID NO: 2086 - RNA, 20 nt, synthetic construct
  source 1..20: mol_type = other RNA
agttggactgtgttaagttt

SEQ ID NO: 2087 - RNA, 20 nt, synthetic construct
  source 1..20: mol_type = other RNA
ccccaagctctgcgtcctgg

SEQ ID NO: 2088 - RNA, 20 nt, synthetic construct
  source 1..20: mol_type = other RNA
ccccttaccggttctcgtgg

SEQ ID NO: 2089 - RNA, 20 nt, synthetic construct
  source 1..20: mol_type = other RNA
caagatcccacgagaaccgg

SEQ ID NO: 2090 - RNA, 20 nt, synthetic construct
  source 1..20: mol_type = other RNA
cgtgggatcttgggaagcca

SEQ ID NO: 2091 - RNA, 20 nt, synthetic construct
  source 1..20: mol_type = other RNA
tctatgagctttgtcgttct

SEQ ID NO: 2092 - RNA, 20 nt, synthetic construct
  source 1..20: mol_type = other RNA
atgagctttgtcgttcttgt

SEQ ID NO: 2093 - RNA, 20 nt, synthetic construct
  source 1..20: mol_type = other RNA
cacaggttgctgtgagactc

SEQ ID NO: 2094 - RNA, 20 nt, synthetic construct
  source 1..20: mol_type = other RNA
actcattggagtctcacagc

SEQ ID NO: 2095 - RNA, 20 nt, synthetic construct
  source 1..20: mol_type = other RNA
aaaagcatctgcacatcctt

SEQ ID NO: 2096 - RNA, 20 nt, synthetic construct
  source 1..20: mol_type = other RNA
cttccaaaagcatctgcaca

SEQ ID NO: 2097 - RNA, 20 nt, synthetic construct
  source 1..20: mol_type = other RNA
ccacacccagcccaccagct

SEQ ID NO: 2098 - RNA, 20 nt, synthetic construct
  source 1..20: mol_type = other RNA
gctgctgccacccttgccag

SEQ ID NO: 2099 - RNA, 20 nt, synthetic construct
  source 1..20: mol_type = other RNA
tacagaggagctgtcctctc

SEQ ID NO: 2100 - RNA, 20 nt, synthetic construct
  source 1..20: mol_type = other RNA
tttccaaccaggtgagacct

SEQ ID NO: 2101 - RNA, 20 nt, synthetic construct
  source 1..20: mol_type = other RNA
aaccaggtgagacctcttca

SEQ ID NO: 2102 - RNA, 20 nt, synthetic construct
  source 1..20: mol_type = other RNA
gtggagccctggagccccct

SEQ ID NO: 2103 - RNA, 20 nt, synthetic construct
  source 1..20: mol_type = other RNA
cagtccctgcctggactggg

SEQ ID NO: 2104 - RNA, 20 nt, synthetic construct
  source 1..20: mol_type = other RNA
aaccgagggggtggtaattt

SEQ ID NO: 2105 - RNA, 20 nt, synthetic construct
  source 1..20: mol_type = other RNA
cttgcctcttccgtgtccca

SEQ ID NO: 2106 - RNA, 20 nt, synthetic construct
  source 1..20: mol_type = other RNA
gtgtcccaacagcggcagca

SEQ ID NO: 2107 - RNA, 20 nt, synthetic construct
  source 1..20: mol_type = other RNA
ctgtgtctctctcctcttca

SEQ ID NO: 2108 - RNA, 20 nt, synthetic construct
  source 1..20: mol_type = other RNA
ttgtctcataaggacacttg

SEQ ID NO: 2109 - RNA, 20 nt, synthetic construct
  source 1..20: mol_type = other RNA
ggcccaagggagaggaggga

SEQ ID NO: 2110 - RNA, 20 nt, synthetic construct
  source 1..20: mol_type = other RNA
ctcctctcccttgggccaga

SEQ ID NO: 2111 - RNA, 20 nt, synthetic construct
  source 1..20: mol_type = other RNA
tccccataggatgcccatgg

SEQ ID NO: 2112 - RNA, 20 nt, synthetic construct
  source 1..20: mol_type = other RNA
ccataggatgcccatggatt

SEQ ID NO: 2113 - RNA, 20 nt, synthetic construct
  source 1..20: mol_type = other RNA
cgcttcccccgagtgtctgt

SEQ ID NO: 2114 - RNA, 20 nt, synthetic construct
  source 1..20: mol_type = other RNA
cccgagtgtctgtgggaggt

SEQ ID NO: 2115 - RNA, 20 nt, synthetic construct
  source 1..20: mol_type = other RNA
tgccacctcccacagacact

SEQ ID NO: 2116 - RNA, 20 nt, synthetic construct
  source 1..20: mol_type = other RNA
acacccctgcctgccattcc

SEQ ID NO: 2117 - RNA, 20 nt, synthetic construct
  source 1..20: mol_type = other RNA
ggagtcatatcaagggcttg

SEQ ID NO: 2118 - RNA, 20 nt, synthetic construct
  source 1..20: mol_type = other RNA
tccagccaagcccttgatat

SEQ ID NO: 2119 - RNA, 20 nt, synthetic construct
  source 1..20: mol_type = other RNA
tcattcatggggaggccaca

SEQ ID NO: 2120 - RNA, 20 nt, synthetic construct
  source 1..20: mol_type = other RNA
ttcatggggaggccacaagc

SEQ ID NO: 2121 - RNA, 20 nt, synthetic construct
  source 1..20: mol_type = other RNA
tggggaggccacaagcatgg

SEQ ID NO: 2122 - RNA, 20 nt, synthetic construct
  source 1..20: mol_type = other RNA
ctgtcaggtattgagtgagg

SEQ ID NO: 2123 - RNA, 20 nt, synthetic construct
  source 1..20: mol_type = other RNA
taccattcaataataacgtt

SEQ ID NO: 2124 - RNA, 20 nt, synthetic construct
  source 1..20: mol_type = other RNA
ttcacatttgtatccccagc

SEQ ID NO: 2125 - RNA, 20 nt, synthetic construct
  source 1..20: mol_type = other RNA
tttcattcacatttgtatcc

SEQ ID NO: 2126 - RNA, 20 nt, synthetic construct
  source 1..20: mol_type = other RNA
ggatacactgttgggggaag

SEQ ID NO: 2127 - RNA, 20 nt, synthetic construct
  source 1..20: mol_type = other RNA
cccaacagtgtatccagaag

SEQ ID NO: 2128 - RNA, 20 nt, synthetic construct
  source 1..20: mol_type = other RNA
ttaaacaaatgctacttgac

SEQ ID NO: 2129 - RNA, 20 nt, synthetic construct
  source 1..20: mol_type = other RNA
gagctctcagcctatccaga

SEQ ID NO: 2130 - RNA, 20 nt, synthetic construct
  source 1..20: mol_type = other RNA
ggataggctgagagctctga

SEQ ID NO: 2131 - RNA, 20 nt, synthetic construct
  source 1..20: mol_type = other RNA
gctggatacacaggctcgca

SEQ ID NO: 2132 - RNA, 20 nt, synthetic construct
  source 1..20: mol_type = other RNA
tgatccttctgctggataca

SEQ ID NO: 2133 - RNA, 20 nt, synthetic construct
  source 1..20: mol_type = other RNA
tggaggaagcgctgttctag

SEQ ID NO: 2134 - RNA, 20 nt, synthetic construct
  source 1..20: mol_type = other RNA
agccaagacctacgggggca

SEQ ID NO: 2135 - RNA, 20 nt, synthetic construct
  source 1..20: mol_type = other RNA
actgcttggacaccgtcccc

SEQ ID NO: 2136 - RNA, 20 nt, synthetic construct
  source 1..20: mol_type = other RNA
ttccactgcttggacaccgt

SEQ ID NO: 2137 - RNA, 20 nt, synthetic construct
  source 1..20: mol_type = other RNA
atccacgttcattccactgc

SEQ ID NO: 2138 - RNA, 20 nt, synthetic construct
  source 1..20: mol_type = other RNA
gcacaggccacactccctcc

SEQ ID NO: 2139 - RNA, 20 nt, synthetic construct
  source 1..20: mol_type = other RNA
catctgacctggaggccacc

SEQ ID NO: 2140 - RNA, 20 nt, synthetic construct
  source 1..20: mol_type = other RNA
tcctttcacatctgacctgg

SEQ ID NO: 2141 - RNA, 20 nt, synthetic construct
  source 1..20: mol_type = other RNA
caggcgtatggcagggctgc

SEQ ID NO: 2142 - RNA, 20 nt, synthetic construct
  source 1..20: mol_type = other RNA
ctctcaccaggcagccctgc

SEQ ID NO: 2143 - RNA, 20 nt, synthetic construct
  source 1..20: mol_type = other RNA
agcctctggaaagctctgtg

SEQ ID NO: 2144 - RNA, 20 nt, synthetic construct
  source 1..20: mol_type = other RNA
tgaggccaccttgccacgct

SEQ ID NO: 2145 - RNA, 20 nt, synthetic construct
  source 1..20: mol_type = other RNA
ctgtgacagcgtggcaaggt

SEQ ID NO: 2146 - RNA, 20 nt, synthetic construct
  source 1..20: mol_type = other RNA
aaacccccgggtgaggcagg

SEQ ID NO: 2147 - RNA, 20 nt, synthetic construct
  source 1..20: mol_type = other RNA
taggcctccctctatcttcc

SEQ ID NO: 2148 - RNA, 20 nt, synthetic construct
  source 1..20: mol_type = other RNA
agtgagaggctggaaagggg

SEQ ID NO: 2149 - RNA, 20 nt, synthetic construct
  source 1..20: mol_type = other RNA
ttccagtgagaggctggaaa

SEQ ID NO: 2150 - RNA, 20 nt, synthetic construct
  source 1..20: mol_type = other RNA
agcctctcactggaaggaag

SEQ ID NO: 2151 - RNA, 20 nt, synthetic construct
  source 1..20: mol_type = other RNA
tgcccgctcacaccagccca

SEQ ID NO: 2152 - RNA, 20 nt, synthetic construct
  source 1..20: mol_type = other RNA
aagtgcaggcggttcctgcc

SEQ ID NO: 2153 - RNA, 20 nt, synthetic construct
  source 1..20: mol_type = other RNA
atctgccgctggggccacac

SEQ ID NO: 2154 - RNA, 20 nt, synthetic construct
  source 1..20: mol_type = other RNA
gctgcaagatgatgtgacca

SEQ ID NO: 2155 - RNA, 20 nt, synthetic construct
  source 1..20: mol_type = other RNA
ggtcccacccgtgcttggga

SEQ ID NO: 2156 - RNA, 20 nt, synthetic construct
  source 1..20: mol_type = other RNA
tcgtcgtgtgtgaggaggga

SEQ ID NO: 2157 - RNA, 20 nt, synthetic construct
  source 1..20: mol_type = other RNA
ctcctcacacacgacgagga

SEQ ID NO: 2158 - RNA, 20 nt, synthetic construct
  source 1..20: mol_type = other RNA
agtccatgttcctcgtcgtg

SEQ ID NO: 2159 - RNA, 20 nt, synthetic construct
  source 1..20: mol_type = other RNA
gctcgatgtgcgttgtgtgg

SEQ ID NO: 2160 - RNA, 20 nt, synthetic construct
  source 1..20: mol_type = other RNA
ctccctggacgtaagccaca

SEQ ID NO: 2161 - RNA, 20 nt, synthetic construct
  source 1..20: mol_type = other RNA
agataagcctgtattccccg

SEQ ID NO: 2162 - RNA, 20 nt, synthetic construct
  source 1..20: mol_type = other RNA
ccgggctgtctgccaatgta

SEQ ID NO: 2163 - RNA, 20 nt, synthetic construct
  source 1..20: mol_type = other RNA
aggctgacgggacaactgga

SEQ ID NO: 2164 - RNA, 20 nt, synthetic construct
  source 1..20: mol_type = other RNA
ctcagagcttccaggctgac

SEQ ID NO: 2165 - RNA, 20 nt, synthetic construct
  source 1..20: mol_type = other RNA
tgagcacctgtatcccctgc

SEQ ID NO: 2166 - RNA, 20 nt, synthetic construct
  source 1..20: mol_type = other RNA
acattccatagcccagctca

SEQ ID NO: 2167 - RNA, 20 nt, synthetic construct
  source 1..20: mol_type = other RNA
atagcccagctcaatatcta

SEQ ID NO: 2168 - RNA, 20 nt, synthetic construct
  source 1..20: mol_type = other RNA
tctagggtggcgagcactgt

SEQ ID NO: 2169 - RNA, 20 nt, synthetic construct
  source 1..20: mol_type = other RNA
ggtcggagctcacagcgctc

SEQ ID NO: 2170 - RNA, 20 nt, synthetic construct
  source 1..20: mol_type = other RNA
cagtgtagcaccgggcacat

SEQ ID NO: 2171 - RNA, 20 nt, synthetic construct
  source 1..20: mol_type = other RNA
ctcatcaataggcatctacc

SEQ ID NO: 2172 - RNA, 20 nt, synthetic construct
  source 1..20: mol_type = other RNA
gtagcatgctgagcaggtcc

SEQ ID NO: 2173 - RNA, 20 nt, synthetic construct
  source 1..20: mol_type = other RNA
tctgtagcatgctgagcagg

SEQ ID NO: 2174 - RNA, 20 nt, synthetic construct
  source 1..20: mol_type = other RNA
tgccgagactggaggcctta

SEQ ID NO: 2175 - RNA, 20 nt, synthetic construct
  source 1..20: mol_type = other RNA
gactgtgcccagacctacta

SEQ ID NO: 2176 - RNA, 20 nt, synthetic construct
  source 1..20: mol_type = other RNA
ggcaaggtcggcccccagtc

SEQ ID NO: 2177 - RNA, 20 nt, synthetic construct
  source 1..20: mol_type = other RNA
tgtgggatctcagagcagcc

SEQ ID NO: 2178 - RNA, 20 nt, synthetic construct
  source 1..20: mol_type = other RNA
gtggctgctctgagatccca

SEQ ID NO: 2179 - RNA, 20 nt, synthetic construct
  source 1..20: mol_type = other RNA
ccaaataaggtctggctcac

SEQ ID NO: 2180 - RNA, 20 nt, synthetic construct
  source 1..20: mol_type = other RNA
ctcataaagacacatcacag

SEQ ID NO: 2181 - RNA, 20 nt, synthetic construct
  source 1..20: mol_type = other RNA
ccaatctccacctctgtctc

SEQ ID NO: 2182 - RNA, 20 nt, synthetic construct
  source 1..20: mol_type = other RNA
tcccagagccttcgctgctg

SEQ ID NO: 2183 - RNA, 20 nt, synthetic construct
  source 1..20: mol_type = other RNA
cagagccttcgctgctgagt

SEQ ID NO: 2184 - RNA, 20 nt, synthetic construct
  source 1..20: mol_type = other RNA
cagactcagcagcgaaggct

SEQ ID NO: 2185 - RNA, 20 nt, synthetic construct
  source 1..20: mol_type = other RNA
ctgctgagtctgggaatttg

SEQ ID NO: 2186 - RNA, 20 nt, synthetic construct
  source 1..20: mol_type = other RNA
gtcacaaattcccagactca

SEQ ID NO: 2187 - RNA, 20 nt, synthetic construct
  source 1..20: mol_type = other RNA
tatggcttcggtcacaaatt

SEQ ID NO: 2188 - RNA, 20 nt, synthetic construct
  source 1..20: mol_type = other RNA
catctcaggacaggtgagca

SEQ ID NO: 2189 - RNA, 20 nt, synthetic construct
  source 1..20: mol_type = other RNA
gaagtgccatctgaacagca

SEQ ID NO: 2190 - RNA, 20 nt, synthetic construct
  source 1..20: mol_type = other RNA
gatggcacttcagaagactc

SEQ ID NO: 2191 - RNA, 20 nt, synthetic construct
  source 1..20: mol_type = other RNA
gaagactcaggagaccctgg

SEQ ID NO: 2192 - RNA, 20 nt, synthetic construct
  source 1..20: mol_type = other RNA
tggctgcaggggttccaggg

SEQ ID NO: 2193 - RNA, 20 nt, synthetic construct
  source 1..20: mol_type = other RNA
gctggcgcaggactctgcta

SEQ ID NO: 2194 - RNA, 20 nt, synthetic construct
  source 1..20: mol_type = other RNA
ggcaggttgctgctagcaga

SEQ ID NO: 2195 - RNA, 20 nt, synthetic construct
  source 1..20: mol_type = other RNA
tttggcctggctgagagttt

SEQ ID NO: 2196 - RNA, 20 nt, synthetic construct
  source 1..20: mol_type = other RNA
gagacctgcgctggagcgga

SEQ ID NO: 2197 - RNA, 20 nt, synthetic construct
  source 1..20: mol_type = other RNA
tctctcccttctccatccag

SEQ ID NO: 2198 - RNA, 20 nt, synthetic construct
  source 1..20: mol_type = other RNA
ccatccagcaggctggacct

SEQ ID NO: 2199 - RNA, 20 nt, synthetic construct
  source 1..20: mol_type = other RNA
cctataccctaacctttgtc

SEQ ID NO: 2200 - RNA, 20 nt, synthetic construct
  source 1..20: mol_type = other RNA
ccaagaagcaggcactgggg

SEQ ID NO: 2201 - RNA, 20 nt, synthetic construct
  source 1..20: mol_type = other RNA
ctgaggttgtgactcgtgtg

SEQ ID NO: 2202 - RNA, 20 nt, synthetic construct
  source 1..20: mol_type = other RNA
gcctcacacgagtcacaacc

SEQ ID NO: 2203 - RNA, 20 nt, synthetic construct
  source 1..20: mol_type = other RNA
ccactccacaagataccagg

SEQ ID NO: 2204 - RNA, 20 nt, synthetic construct
  source 1..20: mol_type = other RNA
tgtctctaaaatgagccggc

SEQ ID NO: 2205 - RNA, 20 nt, synthetic construct
  source 1..20: mol_type = other RNA
cctttgagtctttaaatctt

SEQ ID NO: 2206 - RNA, 20 nt, synthetic construct
  source 1..20: mol_type = other RNA
cagctcaccgagtctgcaag

SEQ ID NO: 2207 - RNA, 20 nt, synthetic construct
  source 1..20: mol_type = other RNA
tgcagactcggtgagctgtg

SEQ ID NO: 2208 - RNA, 20 nt, synthetic construct
  source 1..20: mol_type = other RNA
tatgaaggagcaggatgact

SEQ ID NO: 2209 - RNA, 20 nt, synthetic construct
  source 1..20: mol_type = other RNA
tggcagtagcattgccagct

SEQ ID NO: 2210 - RNA, 20 nt, synthetic construct
  source 1..20: mol_type = other RNA
tagacaaggaaagggaggcc

SEQ ID NO: 2211 - RNA, 20 nt, synthetic construct
  source 1..20: mol_type = other RNA
ccagtgcctgggatgtgctc

SEQ ID NO: 2212 - RNA, 20 nt, synthetic construct
  source 1..20: mol_type = other RNA
gtgtgttaactataaggttg

SEQ ID NO: 2213 - RNA, 20 nt, synthetic construct
  source 1..20: mol_type = other RNA
ctcctctcccacaaatgtcg

SEQ ID NO: 2214 - RNA, 20 nt, synthetic construct
  source 1..20: mol_type = other RNA
aaggcgacatttgtgggaga

SEQ ID NO: 2215 - RNA, 20 nt, synthetic construct
  source 1..20: mol_type = other RNA
cggtggtcactctgtatgct

SEQ ID NO: 2216 - RNA, 20 nt, synthetic construct
  source 1..20: mol_type = other RNA
cgaagtcggtgaccatgacc

SEQ ID NO: 2217 - RNA, 20 nt, synthetic construct
  source 1..20: mol_type = other RNA
agaatgtgcccgaggaggac

SEQ ID NO: 2218 - RNA, 20 nt, synthetic construct
  source 1..20: mol_type = other RNA
acagacaggtaagcacggcc

SEQ ID NO: 2219 - RNA, 20 nt, synthetic construct
  source 1..20: mol_type = other RNA
cacaactgatggcagggagg

SEQ ID NO: 2220 - RNA, 20 nt, synthetic construct
  source 1..20: mol_type = other RNA
tccatccagccacctgctga

SEQ ID NO: 2221 - RNA, 20 nt, synthetic construct
  source 1..20: mol_type = other RNA
catgtggtccttgtgttcgt

SEQ ID NO: 2222 - RNA, 20 nt, synthetic construct
  source 1..20: mol_type = other RNA
tcgagcaggccagcaagtgt

SEQ ID NO: 2223 - RNA, 20 nt, synthetic construct
  source 1..20: mol_type = other RNA
cttggcagttgagcacgcgc

SEQ ID NO: 2224 - RNA, 20 nt, synthetic construct
  source 1..20: mol_type = other RNA
tggttaggagacattagctc

SEQ ID NO: 2225 - RNA, 20 nt, synthetic construct
  source 1..20: mol_type = other RNA
ctggctctgcggcagaggct

SEQ ID NO: 2226 - RNA, 20 nt, synthetic construct
  source 1..20: mol_type = other RNA
tctgcactcgtggccactgg

SEQ ID NO: 2227 - RNA, 20 nt, synthetic construct
  source 1..20: mol_type = other RNA
cagtggccacgagtgcagat

SEQ ID NO: 2228 - RNA, 20 nt, synthetic construct
  source 1..20: mol_type = other RNA
tcatctgcactcgtggccac

SEQ ID NO: 2229 - RNA, 20 nt, synthetic construct
  source 1..20: mol_type = other RNA
gccttgaccctgggtcaatg

SEQ ID NO: 2230 - RNA, 20 nt, synthetic construct
  source 1..20: mol_type = other RNA
acagttccacactgctcccc

SEQ ID NO: 2231 - RNA, 20 nt, synthetic construct
  source 1..20: mol_type = other RNA
atgtggagggactcgaggtg

SEQ ID NO: 2232 - RNA, 20 nt, synthetic construct
  source 1..20: mol_type = other RNA
atcttctgcttgcatacctc

SEQ ID NO: 2233 - RNA, 20 nt, synthetic construct
  source 1..20: mol_type = other RNA
gcttgcatacctctgagacc

SEQ ID NO: 2234 - RNA, 20 nt, synthetic construct
  source 1..20: mol_type = other RNA
tccaccacatctgcctggcc

SEQ ID NO: 2235 - RNA, 20 nt, synthetic construct
  source 1..20: mol_type = other RNA
agactgtgactacatttagt

SEQ ID NO: 2236 - RNA, 20 nt, synthetic construct
  source 1..20: mol_type = other RNA
caactggacttcataggggg

SEQ ID NO: 2237 - RNA, 20 nt, synthetic construct
  source 1..20: mol_type = other RNA
ctgtccaccggcccccagag

SEQ ID NO: 2238 - RNA, 20 nt, synthetic construct
  source 1..20: mol_type = other RNA
ttctgtggccagacattgag

SEQ ID NO: 2239 - RNA, 20 nt, synthetic construct
  source 1..20: mol_type = other RNA
gtggccagacattgagcaag

SEQ ID NO: 2240 - RNA, 20 nt, synthetic construct
  source 1..20: mol_type = other RNA
tcaactatttagcagctacg

SEQ ID NO: 2241 - RNA, 20 nt, synthetic construct
  source 1..20: mol_type = other RNA
ccagcttgagctgtgcgacc

SEQ ID NO: 2242 - RNA, 20 nt, synthetic construct
  source 1..20: mol_type = other RNA
cagcgagttccccagcttga

SEQ ID NO: 2243 - RNA, 20 nt, synthetic construct
  source 1..20: mol_type = other RNA
actgtaagccccagccccca

SEQ ID NO: 2244 - RNA, 20 nt, synthetic construct
  source 1..20: mol_type = other RNA
cagcctttgaaacaggctag

SEQ ID NO: 2245 - RNA, 20 nt, synthetic construct
  source 1..20: mol_type = other RNA
aaggctgagaaggcccagga

SEQ ID NO: 2246 - RNA, 20 nt, synthetic construct
  source 1..20: mol_type = other RNA
gccctgagactttcctacag

SEQ ID NO: 2247 - RNA, 20 nt, synthetic construct
  source 1..20: mol_type = other RNA
tgcctttaaaactgaacatc

SEQ ID NO: 2248 - RNA, 20 nt, synthetic construct
  source 1..20: mol_type = other RNA
gccccatcaggtgacccctt

SEQ ID NO: 2249 - RNA, 20 nt, synthetic construct
  source 1..20: mol_type = other RNA
ggaactgacctgactgagcc

SEQ ID NO: 2250 - RNA, 20 nt, synthetic construct
  source 1..20: mol_type = other RNA
tgaaggtcagtgtgtggagg

SEQ ID NO: 2251 - RNA, 20 nt, synthetic construct
  source 1..20: mol_type = other RNA
gggaaagaacagcctcccct

SEQ ID NO: 2252 - RNA, 20 nt, synthetic construct
  source 1..20: mol_type = other RNA
ttcccagaaaggccttcccc

SEQ ID NO: 2253 - RNA, 20 nt, synthetic construct
  source 1..20: mol_type = other RNA
cagaaaggccttccccaggc

SEQ ID NO: 2254 - RNA, 20 nt, synthetic construct
  source 1..20: mol_type = other RNA
ccaggcctggtgctctggcc

SEQ ID NO: 2255 - RNA, 20 nt, synthetic construct
  source 1..20: mol_type = other RNA
ccaggaagtcctccagaggc

SEQ ID NO: 2256 - RNA, 20 nt, synthetic construct
  source 1..20: mol_type = other RNA
tggagaagtcccttctttgg

SEQ ID NO: 2257 - RNA, 20 nt, synthetic construct
  source 1..20: mol_type = other RNA
ttggggtcccagtcagtgta

SEQ ID NO: 2258 - RNA, 20 nt, synthetic construct
  source 1..20: mol_type = other RNA
catacactgactgggacccc

SEQ ID NO: 2259 - RNA, 20 nt, synthetic construct
  source 1..20: mol_type = other RNA
tcctctgtaagcaggtgatt

SEQ ID NO: 2260 - RNA, 20 nt, synthetic construct
  source 1..20: mol_type = other RNA
tcacctccacactcagtgcc

SEQ ID NO: 2261 - RNA, 20 nt, synthetic construct
  source 1..20: mol_type = other RNA
cctccacactcagtgccact

SEQ ID NO: 2262 - RNA, 20 nt, synthetic construct
  source 1..20: mol_type = other RNA
agctccatccttggccacgg

SEQ ID NO: 2263 - RNA, 20 nt, synthetic construct
  source 1..20: mol_type = other RNA
ggatcctggcctctaagatg

SEQ ID NO: 2264 - RNA, 20 nt, synthetic construct
  source 1..20: mol_type = other RNA
cccctgtcaaatgaggtgtg

SEQ ID NO: 2265 - RNA, 20 nt, synthetic construct
  source 1..20: mol_type = other RNA
aggtccccttgcacatcagg

SEQ ID NO: 2266 - RNA, 20 nt, synthetic construct
  source 1..20: mol_type = other RNA
aaccctctgccagcctgtga

SEQ ID NO: 2267 - RNA, 20 nt, synthetic construct
  source 1..20: mol_type = other RNA
ggcctcagtggcactccact

SEQ ID NO: 2268 - RNA, 20 nt, synthetic construct
  source 1..20: mol_type = other RNA
ttctggcctcagtggcactc

SEQ ID NO: 2269 - RNA, 20 nt, synthetic construct
  source 1..20: mol_type = other RNA
ttagacaatcctgggagcaa

SEQ ID NO: 2270 - RNA, 20 nt, synthetic construct
  source 1..20: mol_type = other RNA
cagagggcggggccacacag

SEQ ID NO: 2271 - RNA, 20 nt, synthetic construct
  source 1..20: mol_type = other RNA
agtttgtgtgggtccaacac

SEQ ID NO: 2272 - RNA, 20 nt, synthetic construct
  source 1..20: mol_type = other RNA
cccgccactctctgaggcct

SEQ ID NO: 2273 - RNA, 20 nt, synthetic construct
  source 1..20: mol_type = other RNA
ccacccaacttcccccgcca

SEQ ID NO: 2274 - RNA, 20 nt, synthetic construct
  source 1..20: mol_type = other RNA
cattcctctgaggctcatcc

SEQ ID NO: 2275 - RNA, 20 nt, synthetic construct
  source 1..20: mol_type = other RNA
tctgaggctcatcctcttgg

SEQ ID NO: 2276 - RNA, 20 nt, synthetic construct
  source 1..20: mol_type = other RNA
atgaaagagaggcaccaaga

SEQ ID NO: 2277 - RNA, 20 nt, synthetic construct
  source 1..20: mol_type = other RNA
tggaaagggataataaggtt

SEQ ID NO: 2278 - RNA, 20 nt, synthetic construct
  source 1..20: mol_type = other RNA
tatattcagacgcttagaca

SEQ ID NO: 2279 - RNA, 20 nt, synthetic construct
  source 1..20: mol_type = other RNA
gacgcttagacagagccagg

SEQ ID NO: 2280 - RNA, 20 nt, synthetic construct
  source 1..20: mol_type = other RNA
ctgtgcctggctctgtctaa

SEQ ID NO: 2281 - RNA, 20 nt, synthetic construct
  source 1..20: mol_type = other RNA
agctcatgtgaccgtgcggg

SEQ ID NO: 2282 - RNA, 20 nt, synthetic construct
  source 1..20: mol_type = other RNA
gacttgccagcccgcacggt

SEQ ID NO: 2283 - RNA, 20 nt, synthetic construct
  source 1..20: mol_type = other RNA
gcaggaattgccagcctgcc

SEQ ID NO: 2284 - RNA, 20 nt, synthetic construct
  source 1..20: mol_type = other RNA
tgcagaatttgatgttgcaa

SEQ ID NO: 2285 - RNA, 20 nt, synthetic construct
  source 1..20: mol_type = other RNA
gccccaggactgccttagga

SEQ ID NO: 2286 - RNA, 20 nt, synthetic construct
  source 1..20: mol_type = other RNA
ttcttccctgggaggcctca

SEQ ID NO: 2287 - RNA, 20 nt, synthetic construct
  source 1..20: mol_type = other RNA
tccctgggaggcctcagtct

SEQ ID NO: 2288 - RNA, 20 nt, synthetic construct
  source 1..20: mol_type = other RNA
ctgggaggcctcagtctgtt

SEQ ID NO: 2289 - RNA, 20 nt, synthetic construct
  source 1..20: mol_type = other RNA
cagcagcatttccactggct

SEQ ID NO: 2290 - RNA, 20 nt, synthetic construct
  source 1..20: mol_type = other RNA
cagcccctcccttacaggca

SEQ ID NO: 2291 - RNA, 20 nt, synthetic construct
  source 1..20: mol_type = other RNA
tcccaggcctggagtttatt

SEQ ID NO: 2292 - RNA, 20 nt, synthetic construct
  source 1..20: mol_type = other RNA
gaataaactccaggcctggg

SEQ ID NO: 2293 - RNA, 20 nt, synthetic construct
  source 1..20: mol_type = other RNA
gaaaagccagctggtccagc

SEQ ID NO: 2294 - RNA, 20 nt, synthetic construct
  source 1..20: mol_type = other RNA
gggacgatgcctgcctctac

SEQ ID NO: 2295 - RNA, 20 nt, synthetic construct
  source 1..20: mol_type = other RNA
tgtggcacgtgggcttcttg

SEQ ID NO: 2296 - RNA, 20 nt, synthetic construct
  source 1..20: mol_type = other RNA
tgtggcacgttcctggaggc

SEQ ID NO: 2297 - RNA, 20 nt, synthetic construct
  source 1..20: mol_type = other RNA
gcctccaggaacgtgccaca

SEQ ID NO: 2298 - RNA, 20 nt, synthetic construct
  source 1..20: mol_type = other RNA
tggaggccgaacccttctgg

SEQ ID NO: 2299 - RNA, 20 nt, synthetic construct
  source 1..20: mol_type = other RNA
aaagccagaagggttcggcc

SEQ ID NO: 2300 - RNA, 20 nt, synthetic construct
  source 1..20: mol_type = other RNA
ggctttggaaggagtcgtca

SEQ ID NO: 2301 - RNA, 20 nt, synthetic construct
  source 1..20: mol_type = other RNA
tccccagcctcccgcatggc

SEQ ID NO: 2302 - RNA, 20 nt, synthetic construct
  source 1..20: mol_type = other RNA
agccccttcctccccagcct

SEQ ID NO: 2303 - RNA, 20 nt, synthetic construct
  source 1..20: mol_type = other RNA
gactctgcgatgatggaggt

SEQ ID NO: 2304 - RNA, 20 nt, synthetic construct
  source 1..20: mol_type = other RNA
ggagggagagtggccaggac

SEQ ID NO: 2305 - RNA, 20 nt, synthetic construct
  source 1..20: mol_type = other RNA
ggtacccgccccctccccat

SEQ ID NO: 2306 - RNA, 20 nt, synthetic construct
  source 1..20: mol_type = other RNA
cattagccttgctcaagttg

SEQ ID NO: 2307 - RNA, 20 nt, synthetic construct
  source 1..20: mol_type = other RNA
tcgggtgagaggtctgagcc

SEQ ID NO: 2308 - RNA, 20 nt, synthetic construct
  source 1..20: mol_type = other RNA
cctagatacccgcagtgtcc

SEQ ID NO: 2309 - RNA, 20 nt, synthetic construct
  source 1..20: mol_type = other RNA
ttcccctagatacccgcagt

SEQ ID NO: 2310 - RNA, 20 nt, synthetic construct
  source 1..20: mol_type = other RNA
agacttgaagtggaacaaga

SEQ ID NO: 2311 - RNA, 20 nt, synthetic construct
  source 1..20: mol_type = other RNA
acttcaagtctggaacttca

SEQ ID NO: 2312 - RNA, 20 nt, synthetic construct
  source 1..20: mol_type = other RNA
agtctggaacttcaagtctg

SEQ ID NO: 2313 - RNA, 20 nt, synthetic construct
  source 1..20: mol_type = other RNA
agtctgtgtgtgtgcgtgcg

SEQ ID NO: 2314 - RNA, 20 nt, synthetic construct
  source 1..20: mol_type = other RNA
gccgccagggaagccttgat

SEQ ID NO: 2315 - RNA, 20 nt, synthetic construct
  source 1..20: mol_type = other RNA
ctggcggccgaatttaaagg

SEQ ID NO: 2316 - RNA, 20 nt, synthetic construct
  source 1..20: mol_type = other RNA
ccccgtggcacttagaacca

SEQ ID NO: 2317 - RNA, 20 nt, synthetic construct
  source 1..20: mol_type = other RNA
gtgtatcaagtggttctaag

SEQ ID NO: 2318 - RNA, 20 nt, synthetic construct
  source 1..20: mol_type = other RNA
tatctcccccactaggatgt

SEQ ID NO: 2319 - RNA, 20 nt, synthetic construct
  source 1..20: mol_type = other RNA
caatgcccctgtggagttta

SEQ ID NO: 2320 - RNA, 20 nt, synthetic construct
  source 1..20: mol_type = other RNA
ttaggaggggacatttgagt

SEQ ID NO: 2321 - RNA, 20 nt, synthetic construct
  source 1..20: mol_type = other RNA
ctgccacccacctcctcacc

SEQ ID NO: 2322 - RNA, 20 nt, synthetic construct
  source 1..20: mol_type = other RNA
aggtcatcacagttggggcc

SEQ ID NO: 2323 - RNA, 20 nt, synthetic construct
  source 1..20: mol_type = other RNA
tctctggtccccctgcacag

SEQ ID NO: 2324 - RNA, 20 nt, synthetic construct
  source 1..20: mol_type = other RNA
aggacactcagtctgatgag

SEQ ID NO: 2325 - RNA, 20 nt, synthetic construct
  source 1..20: mol_type = other RNA
tctgtgcactcgcctccctc

SEQ ID NO: 2326 - RNA, 20 nt, synthetic construct
  source 1..20: mol_type = other RNA
ctgaccctcgggctgggcag

SEQ ID NO: 2327 - RNA, 20 nt, synthetic construct
  source 1..20: mol_type = other RNA
tccatcaagctcccgatcaa

SEQ ID NO: 2328 - RNA, 20 nt, synthetic construct
  source 1..20: mol_type = other RNA
cctggccgataagacagcaa

SEQ ID NO: 2329 - RNA, 20 nt, synthetic construct
  source 1..20: mol_type = other RNA
cgaaggtaagccgcctgcag

SEQ ID NO: 2330 - RNA, 20 nt, synthetic construct
  source 1..20: mol_type = other RNA
agaagagagcttagtgtctg

SEQ ID NO: 2331 - RNA, 20 nt, synthetic construct
  source 1..20: mol_type = other RNA
cccctgcaccaggcattgca

SEQ ID NO: 2332 - RNA, 20 nt, synthetic construct
  source 1..20: mol_type = other RNA
ctgccaaagatgtcatcaat

SEQ ID NO: 2333 - RNA, 20 nt, synthetic construct
  source 1..20: mol_type = other RNA
ctgaggaccagcgggtactg

SEQ ID NO: 2334 - RNA, 20 nt, synthetic construct
  source 1..20: mol_type = other RNA
cccttgtctgtgtaaggagg

SEQ ID NO: 2335 - RNA, 20 nt, synthetic construct
  source 1..20: mol_type = other RNA
catttaatcctatttaaggt

SEQ ID NO: 2336 - RNA, 20 nt, synthetic construct
  source 1..20: mol_type = other RNA
gagccccattctcatttaat

SEQ ID NO: 2337 - RNA, 20 nt, synthetic construct
  source 1..20: mol_type = other RNA
ttaagccctcctctctccta

SEQ ID NO: 2338 - RNA, 20 nt, synthetic construct
  source 1..20: mol_type = other RNA
tggtaggagagaggagggct

SEQ ID NO: 2339 - RNA, 20 nt, synthetic construct
  source 1..20: mol_type = other RNA
gtggaggtcccctcactccc

SEQ ID NO: 2340 - RNA, 20 nt, synthetic construct
  source 1..20: mol_type = other RNA
cactcctggagaaactggag

SEQ ID NO: 2341 - RNA, 20 nt, synthetic construct
  source 1..20: mol_type = other RNA
ccaggagtgggaagcggcgg

SEQ ID NO: 2342 - RNA, 20 nt, synthetic construct
  source 1..20: mol_type = other RNA
gtaagcttacagggctggcc

SEQ ID NO: 2343 - RNA, 20 nt, synthetic construct
  source 1..20: mol_type = other RNA
cgcggctgggggctgctgga

SEQ ID NO: 2344 - RNA, 20 nt, synthetic construct
  source 1..20: mol_type = other RNA
cgctgtggctctctccagca

SEQ ID NO: 2345 - RNA, 20 nt, synthetic construct
  source 1..20: mol_type = other RNA
tagaggctgcaggacagtgc

SEQ ID NO: 2346 - RNA, 20 nt, synthetic construct
  source 1..20: mol_type = other RNA
atgctcacctgggtgtgagc

SEQ ID NO: 2347 - RNA, 20 nt, synthetic construct
  source 1..20: mol_type = other RNA
gggagctgagaaatctcaaa

SEQ ID NO: 2348 - RNA, 20 nt, synthetic construct
  source 1..20: mol_type = other RNA
accaaaatgctgcaaccaga

SEQ ID NO: 2349 - RNA, 20 nt, synthetic construct
  source 1..20: mol_type = other RNA
ggcttgaggagatggggtct

SEQ ID NO: 2350 - RNA, 20 nt, synthetic construct
  source 1..20: mol_type = other RNA
aaatggagatagagagaaat

SEQ ID NO: 2351 - RNA, 20 nt, synthetic construct
  source 1..20: mol_type = other RNA
aaacacagagtggtttcaaa

SEQ ID NO: 2352 - RNA, 20 nt, synthetic construct
  source 1..20: mol_type = other RNA
tccaaacacagagtggtttc

SEQ ID NO: 2353 - RNA, 20 nt, synthetic construct
  source 1..20: mol_type = other RNA
gccagtgggcagctctgaat

SEQ ID NO: 2354 - RNA, 20 nt, synthetic construct
  source 1..20: mol_type = other RNA
gagctgcccactggcagaac

SEQ ID NO: 2355 - RNA, 20 nt, synthetic construct
  source 1..20: mol_type = other RNA
ttgggcaggagtgagctcct

SEQ ID NO: 2356 - RNA, 20 nt, synthetic construct
  source 1..20: mol_type = other RNA
ggggacaaggagctcactcc

SEQ ID NO: 2357 - RNA, 20 nt, synthetic construct
  source 1..20: mol_type = other RNA
aagcccattctaaagcagat

SEQ ID NO: 2358 - RNA, 20 nt, synthetic construct
  source 1..20: mol_type = other RNA
aaagcagattcccatttccg

SEQ ID NO: 2359 - RNA, 20 nt, synthetic construct
  source 1..20: mol_type = other RNA
catttccgtctttgactcta

SEQ ID NO: 2360 - RNA, 20 nt, synthetic construct
  source 1..20: mol_type = other RNA
gtctttgactctaaggccca

SEQ ID NO: 2361 - RNA, 20 nt, synthetic construct
  source 1..20: mol_type = other RNA
ccttatgcacccactgcccg

SEQ ID NO: 2362 - RNA, 20 nt, synthetic construct
  source 1..20: mol_type = other RNA
atactctggttctgccactt

SEQ ID NO: 2363 - RNA, 20 nt, synthetic construct
  source 1..20: mol_type = other RNA
gccacttccatgccctttga

SEQ ID NO: 2364 - RNA, 20 nt, synthetic construct
  source 1..20: mol_type = other RNA
atgccctttgagcctgggca

SEQ ID NO: 2365 - RNA, 20 nt, synthetic construct
  source 1..20: mol_type = other RNA
cctcatctcagcttcctcct

SEQ ID NO: 2366 - RNA, 20 nt, synthetic construct
  source 1..20: mol_type = other RNA
tcctccataagagggaaaaa

SEQ ID NO: 2367 - RNA, 20 nt, synthetic construct
  source 1..20: mol_type = other RNA
gccccagccgggggcctctc

SEQ ID NO: 2368 - RNA, 20 nt, synthetic construct
  source 1..20: mol_type = other RNA
aaccgaggtctgccctcctt

SEQ ID NO: 2369 - RNA, 20 nt, synthetic construct
  source 1..20: mol_type = other RNA
ccctgccgctctatagctgt

SEQ ID NO: 2370 - RNA, 20 nt, synthetic construct
  source 1..20: mol_type = other RNA
tcatacagagatgttaagta

SEQ ID NO: 2371 - RNA, 20 nt, synthetic construct
  source 1..20: mol_type = other RNA
agctatcgttactattgttt

SEQ ID NO: 2372 - RNA, 20 nt, synthetic construct
  source 1..20: mol_type = other RNA
tcacccgttgctttaaaatc

SEQ ID NO: 2373 - RNA, 20 nt, synthetic construct
  source 1..20: mol_type = other RNA
acacagggtagcccgtcaat

SEQ ID NO: 2374 - RNA, 20 nt, synthetic construct
  source 1..20: mol_type = other RNA
tgctacctgcctgggcatgt

SEQ ID NO: 2375 - RNA, 20 nt, synthetic construct
  source 1..20: mol_type = other RNA
ggttgggtggagcatgagag

SEQ ID NO: 2376 - RNA, 20 nt, synthetic construct
  source 1..20: mol_type = other RNA
cagacctctcatgctccacc

SEQ ID NO: 2377 - RNA, 20 nt, synthetic construct
  source 1..20: mol_type = other RNA
aggctggagtcccactgtct

SEQ ID NO: 2378 - RNA, 20 nt, synthetic construct
  source 1..20: mol_type = other RNA
cctggacgtgctcagacgag

SEQ ID NO: 2379 - RNA, 20 nt, synthetic construct
  source 1..20: mol_type = other RNA
cgtctgagcacgtccagggg

SEQ ID NO: 2380 - RNA, 20 nt, synthetic construct
  source 1..20: mol_type = other RNA
caaaccctcagtggttcccc

SEQ ID NO: 2381 - RNA, 20 nt, synthetic construct
  source 1..20: mol_type = other RNA
gggcacagcaggctggcatg

SEQ ID NO: 2382 - RNA, 20 nt, synthetic construct
  source 1..20: mol_type = other RNA
tgaacatccatcctacatgc

SEQ ID NO: 2383 - RNA, 20 nt, synthetic construct
  source 1..20: mol_type = other RNA
ggaaagatgagcatagtcag

SEQ ID NO: 2384 - RNA, 20 nt, synthetic construct
  source 1..20: mol_type = other RNA
ctccaagccaggacccctga

SEQ ID NO: 2385 - RNA, 20 nt, synthetic construct
  source 1..20: mol_type = other RNA
ggggtcctggcttggaggga

SEQ ID NO: 2386 - RNA, 20 nt, synthetic construct
  source 1..20: mol_type = other RNA
aaaggggagcgtgattagag

SEQ ID NO: 2387 - RNA, 20 nt, synthetic construct
  source 1..20: mol_type = other RNA
aactgacatgtgcctgtgag

SEQ ID NO: 2388 - RNA, 20 nt, synthetic construct
  source 1..20: mol_type = other RNA
atgacttcaaactgacatgt

SEQ ID NO: 2389 - RNA, 20 nt, synthetic construct
  source 1..20: mol_type = other RNA
tggagtcagattccatgact

SEQ ID NO: 2390 - RNA, 20 nt, synthetic construct
  source 1..20: mol_type = other RNA
cttagctgcaaaatggtgct

SEQ ID NO: 2391 - RNA, 20 nt, synthetic construct
  source 1..20: mol_type = other RNA
ctatgtcctagctgcaaggg

SEQ ID NO: 2392 - RNA, 20 nt, synthetic construct
  source 1..20: mol_type = other RNA
gagcacatgccaggctccat

SEQ ID NO: 2393 - RNA, 20 nt, synthetic construct
  source 1..20: mol_type = other RNA
cacgtgtcatcttcacagtg

SEQ ID NO: 2394 - RNA, 20 nt, synthetic construct
  source 1..20: mol_type = other RNA
cagtgtccctgtgagtaggt

SEQ ID NO: 2395 - RNA, 20 nt, synthetic construct
  source 1..20: mol_type = other RNA
ctttccatcttacaaatgag

SEQ ID NO: 2396 - RNA, 20 nt, synthetic construct
  source 1..20: mol_type = other RNA
atcttacaaatgagtaaaca

SEQ ID NO: 2397 - RNA, 20 nt, synthetic construct
  source 1..20: mol_type = other RNA
tagccaatgggtgtgtctga

SEQ ID NO: 2398 - RNA, 20 nt, synthetic construct
  source 1..20: mol_type = other RNA
gaggtggttcagacagaccc

SEQ ID NO: 2399 - RNA, 20 nt, synthetic construct
  source 1..20: mol_type = other RNA
gacagaccccggcttaccct

SEQ ID NO: 2400 - RNA, 20 nt, synthetic construct
  source 1..20: mol_type = other RNA
agggtaagccggggtctgtc

SEQ ID NO: 2401 - RNA, 20 nt, synthetic construct
  source 1..20: mol_type = other RNA
gcctgctggctgcataggga

SEQ ID NO: 2402 - RNA, 20 nt, synthetic construct
  source 1..20: mol_type = other RNA
acccagagatggagacagtg

SEQ ID NO: 2403 - RNA, 20 nt, synthetic construct
  source 1..20: mol_type = other RNA
cagggaaaacaccatctttc

SEQ ID NO: 2404 - RNA, 20 nt, synthetic construct
  source 1..20: mol_type = other RNA
ctgagaaactaaggctcaga

SEQ ID NO: 2405 - RNA, 20 nt, synthetic construct
  source 1..20: mol_type = other RNA
ttgagttgtttctaggtttc

SEQ ID NO: 2406 - RNA, 20 nt, synthetic construct
  source 1..20: mol_type = other RNA
aggtttcctagctcttgcct

SEQ ID NO: 2407 - RNA, 20 nt, synthetic construct
  source 1..20: mol_type = other RNA
tagctcttgcctcagacctt

SEQ ID NO: 2408 - RNA, 20 nt, synthetic construct
  source 1..20: mol_type = other RNA
catctgagctggctttcctc

SEQ ID NO: 2409 - RNA, 20 nt, synthetic construct
  source 1..20: mol_type = other RNA
tctgccccaggctgcagctc

SEQ ID NO: 2410 - RNA, 20 nt, synthetic construct
  source 1..20: mol_type = other RNA
tgctgccatgccccaggtct

SEQ ID NO: 2411 - RNA, 20 nt, synthetic construct
  source 1..20: mol_type = other RNA
agacctggggcatggcagca

SEQ ID NO: 2412 - RNA, 20 nt, synthetic construct
  source 1..20: mol_type = other RNA
atgctccttgactttgcatt

SEQ ID NO: 2413 - RNA, 20 nt, synthetic construct
  source 1..20: mol_type = other RNA
cctgctcctgaggggccggg

SEQ ID NO: 2414 - RNA, 20 nt, synthetic construct
  source 1..20: mol_type = other RNA
gtgtcagtttgtgccaccac

SEQ ID NO: 2415 - RNA, 20 nt, synthetic construct
  source 1..20: mol_type = other RNA
gccattgtgtggacagcatg

SEQ ID NO: 2416 - RNA, 20 nt, synthetic construct
  source 1..20: mol_type = other RNA
actccaagtggagtggggta

SEQ ID NO: 2417 - RNA, 20 nt, synthetic construct
  source 1..20: mol_type = other RNA
ttatgccatatttatgcaca

SEQ ID NO: 2418 - RNA, 20 nt, synthetic construct
  source 1..20: mol_type = other RNA
gcatgcagctcaggcacccc

SEQ ID NO: 2419 - RNA, 20 nt, synthetic construct
  source 1..20: mol_type = other RNA
tgccttgctggtcatgctaa

SEQ ID NO: 2420 - RNA, 20 nt, synthetic construct
  source 1..20: mol_type = other RNA
agggcttggcacatgccttg

SEQ ID NO: 2421 - RNA, 20 nt, synthetic construct
  source 1..20: mol_type = other RNA
agaaggcccggctgtcacat

SEQ ID NO: 2422 - RNA, 20 nt, synthetic construct
  source 1..20: mol_type = other RNA
agaaacctgagtgtataact

SEQ ID NO: 2423 - RNA, 20 nt, synthetic construct
  source 1..20: mol_type = other RNA
tttaagagtggactccttag

SEQ ID NO: 2424 - RNA, 20 nt, synthetic construct
  source 1..20: mol_type = other RNA
ggtctggatggtgcattcct

SEQ ID NO: 2425 - RNA, 20 nt, synthetic construct
  source 1..20: mol_type = other RNA
tcgagagcaaaagacagtct

SEQ ID NO: 2426 - RNA, 20 nt, synthetic construct
  source 1..20: mol_type = other RNA
aggtgctcttcctggcactg

SEQ ID NO: 2427 - RNA, 20 nt, synthetic construct
  source 1..20: mol_type = other RNA
ccctcctggagcatctattt

SEQ ID NO: 2428 - RNA, 20 nt, synthetic construct
  source 1..20: mol_type = other RNA
tccactaaaatagatgctcc

SEQ ID NO: 2429 - RNA, 20 nt, synthetic construct
  source 1..20: mol_type = other RNA
gtcttcctccactaaaatag

SEQ ID NO: 2430 - RNA, 20 nt, synthetic construct
  source 1..20: mol_type = other RNA
gtactctatattaatggttt

SEQ ID NO: 2431 - RNA, 20 nt, synthetic construct
  source 1..20: mol_type = other RNA
tccaccttgtcagcgagacc

SEQ ID NO: 2432 - RNA, 20 nt, synthetic construct
  source 1..20: mol_type = other RNA
ctgcctcatggcctgtttcg

SEQ ID NO: 2433 - RNA, 20 nt, synthetic construct
  source 1..20: mol_type = other RNA
aggcaaagcaaaggccccca

SEQ ID NO: 2434 - RNA, 20 nt, synthetic construct
  source 1..20: mol_type = other RNA
tggtactccctgcacatccc

SEQ ID NO: 2435 - RNA, 20 nt, synthetic construct
  source 1..20: mol_type = other RNA
cacctctctggtttcctggt

SEQ ID NO: 2436 - RNA, 20 nt, synthetic construct
  source 1..20: mol_type = other RNA
gatccaggccagaccacact

SEQ ID NO: 2437 - RNA, 20 nt, synthetic construct
  source 1..20: mol_type = other RNA
cagctcagcagctaggccac

SEQ ID NO: 2438 - RNA, 20 nt, synthetic construct
  source 1..20: mol_type = other RNA
gcccaaggtccttgtcatct

SEQ ID NO: 2439 - RNA, 20 nt, synthetic construct
  source 1..20: mol_type = other RNA
gactccagcctgagccccgc

SEQ ID NO: 2440 - RNA, 20 nt, synthetic construct
  source 1..20: mol_type = other RNA
gagggatgagtttggcactg

SEQ ID NO: 2441 - RNA, 20 nt, synthetic construct
  source 1..20: mol_type = other RNA
tgcctggtttgagggccgtg

SEQ ID NO: 2442 - RNA, 20 nt, synthetic construct
  source 1..20: mol_type = other RNA
gcaccatggctgaccaaaca

SEQ ID NO: 2443 - RNA, 20 nt, synthetic construct
  source 1..20: mol_type = other RNA
gtgaggccaaagtgcagacg

SEQ ID NO: 2444 - RNA, 20 nt, synthetic construct
  source 1..20: mol_type = other RNA
ccctccgacatccttctgtg

SEQ ID NO: 2445 - RNA, 20 nt, synthetic construct
  source 1..20: mol_type = other RNA
tttctccctccgacatcctt

SEQ ID NO: 2446 - RNA, 20 nt, synthetic construct
  source 1..20: mol_type = other RNA
tttcctcgggctctggcagg

SEQ ID NO: 2447 - RNA, 20 nt, synthetic construct
  source 1..20: mol_type = other RNA
tcgggctctggcaggtgacc

SEQ ID NO: 2448 - RNA, 20 nt, synthetic construct
  source 1..20: mol_type = other RNA
ctggtgctgcctgtagtgct

SEQ ID NO: 2449 - RNA, 20 nt, synthetic construct
  source 1..20: mol_type = other RNA
gacttgtccctctctcagcc

SEQ ID NO: 2450 - RNA, 20 nt, synthetic construct
  source 1..20: mol_type = other RNA
gcctttccggggctgctggc

SEQ ID NO: 2451 - RNA, 20 nt, synthetic construct
  source 1..20: mol_type = other RNA
ggggctgctggcctggccct

SEQ ID NO: 2452 - RNA, 20 nt, synthetic construct
  source 1..20: mol_type = other RNA
aggcaaggaggctgccccac

SEQ ID NO: 2453 - RNA, 20 nt, synthetic construct
  source 1..20: mol_type = other RNA
tggcacctccacctggggag

SEQ ID NO: 2454 - RNA, 20 nt, synthetic construct
  source 1..20: mol_type = other RNA
ccattcaaacaggtcgagct

SEQ ID NO: 2455 - RNA, 20 nt, synthetic construct
  source 1..20: mol_type = other RNA
aacaggtcgagctgtgctcg

SEQ ID NO: 2456 - RNA, 20 nt, synthetic construct
  source 1..20: mol_type = other RNA
gcccacggacatcggcacat

SEQ ID NO: 2457 - RNA, 20 nt, synthetic construct
  source 1..20: mol_type = other RNA
gtgccaggcattcaatcctc

SEQ ID NO: 2458 - RNA, 20 nt, synthetic construct
  source 1..20: mol_type = other RNA
atcctcaggtctccaccaag

SEQ ID NO: 2459 - RNA, 20 nt, synthetic construct
  source 1..20: mol_type = other RNA
tcccatggataggggagggg

SEQ ID NO: 2460 - RNA, 20 nt, synthetic construct
  source 1..20: mol_type = other RNA
catggataggggagggggcg

SEQ ID NO: 2461 - RNA, 20 nt, synthetic construct
  source 1..20: mol_type = other RNA
ccacagttagctggagatga

SEQ ID NO: 2462 - RNA, 20 nt, synthetic construct
  source 1..20: mol_type = other RNA
ggatggcatctagccagagg

SEQ ID NO: 2463 - RNA, 20 nt, synthetic construct
  source 1..20: mol_type = other RNA
tgagccacctttactctgct

SEQ ID NO: 2464 - RNA, 20 nt, synthetic construct
  source 1..20: mol_type = other RNA
tctgtgaagtaggggtgcga

SEQ ID NO: 2465 - RNA, 20 nt, synthetic construct
  source 1..20: mol_type = other RNA
tcctctgtgaagtaggggtg

SEQ ID NO: 2466 - RNA, 20 nt, synthetic construct
  source 1..20: mol_type = other RNA
cagaggaagaaacctggaac

SEQ ID NO: 2467 - RNA, 20 nt, synthetic construct
  source 1..20: mol_type = other RNA
tgctgtgtgagcttggcagg

SEQ ID NO: 2468 - RNA, 20 nt, synthetic construct
  source 1..20: mol_type = other RNA
ggctcagttcctgctgtgtg

SEQ ID NO: 2469 - RNA, 20 nt, synthetic construct
  source 1..20: mol_type = other RNA
gagccagcccaatctgcgtt

SEQ ID NO: 2470 - RNA, 20 nt, synthetic construct
  source 1..20: mol_type = other RNA
tacttcacccggctgggctc

SEQ ID NO: 2471 - RNA, 20 nt, synthetic construct
  source 1..20: mol_type = other RNA
cccggctgggctcctcattt

SEQ ID NO: 2472 - RNA, 20 nt, synthetic construct
  source 1..20: mol_type = other RNA
cagcctcactgttacccgta

SEQ ID NO: 2473 - RNA, 20 nt, synthetic construct
  source 1..20: mol_type = other RNA
ccttcccagcctcactgtta

SEQ ID NO: 2474 - RNA, 20 nt, synthetic construct
  source 1..20: mol_type = other RNA
tggtctgtgttccccttccc

SEQ ID NO: 2475 - RNA, 20 nt, synthetic construct
  source 1..20: mol_type = other RNA
gccatcactcaccgagcttc

SEQ ID NO: 2476 - RNA, 20 nt, synthetic construct
  source 1..20: mol_type = other RNA
atgcctgcaggcatcgttct

SEQ ID NO: 2477 - RNA, 20 nt, synthetic construct
  source 1..20: mol_type = other RNA
gttatcacccaggcctgatt

SEQ ID NO: 2478 - RNA, 20 nt, synthetic construct
  source 1..20: mol_type = other RNA
ctggcctggcggagatgctt

SEQ ID NO: 2479 - RNA, 20 nt, synthetic construct
  source 1..20: mol_type = other RNA
aaggcatggtcgggggagag

SEQ ID NO: 2480 - RNA, 20 nt, synthetic construct
  source 1..20: mol_type = other RNA
agttacaaaagcaaaacagg

SEQ ID NO: 2481 - RNA, 20 nt, synthetic construct
  source 1..20: mol_type = other RNA
tagtataagcaaggcatcac

SEQ ID NO: 2482 - RNA, 20 nt, synthetic construct
  source 1..20: mol_type = other RNA
acaaacttacccagttccta

SEQ ID NO: 2483 - RNA, 20 nt, synthetic construct
  source 1..20: mol_type = other RNA
catcaccagtacttgcccaa

SEQ ID NO: 2484 - RNA, 20 nt, synthetic construct
  source 1..20: mol_type = other RNA
taggataggcacaaggagta

SEQ ID NO: 2485 - RNA, 20 nt, synthetic construct
  source 1..20: mol_type = other RNA
ttcctaggataggcacaagg

SEQ ID NO: 2486 - RNA, 20 nt, synthetic construct
  source 1..20: mol_type = other RNA
tgcagctcccctgaccaccc

SEQ ID NO: 2487 - RNA, 20 nt, synthetic construct
  source 1..20: mol_type = other RNA
tttctccccagtacctggca

SEQ ID NO: 2488 - RNA, 20 nt, synthetic construct
  source 1..20: mol_type = other RNA
ccccagtacctggcacacag

SEQ ID NO: 2489 - RNA, 20 nt, synthetic construct
  source 1..20: mol_type = other RNA
gtaaatactcgggccaggct

SEQ ID NO: 2490 - RNA, 20 nt, synthetic construct
  source 1..20: mol_type = other RNA
gtaatgagccagtgctaagt

SEQ ID NO: 2491 - RNA, 20 nt, synthetic construct
  source 1..20: mol_type = other RNA
tgatttaaaattcagaacag

SEQ ID NO: 2492 - RNA, 20 nt, synthetic construct
  source 1..20: mol_type = other RNA
gaacagtctcagattgggtg

SEQ ID NO: 2493 - RNA, 20 nt, synthetic construct
  source 1..20: mol_type = other RNA
taaacacaagcaatcctcct

SEQ ID NO: 2494 - RNA, 20 nt, synthetic construct
  source 1..20: mol_type = other RNA
agaccctgggcaacagtgag

SEQ ID NO: 2495 - RNA, 20 nt, synthetic construct
  source 1..20: mol_type = other RNA
atgtgggacctccaggccct

SEQ ID NO: 2496 - RNA, 20 nt, synthetic construct
  source 1..20: mol_type = other RNA
ccagccttagagtggagggc

SEQ ID NO: 2497 - RNA, 20 nt, synthetic construct
  source 1..20: mol_type = other RNA
ctctctctctagacagccca

SEQ ID NO: 2498 - RNA, 20 nt, synthetic construct
  source 1..20: mol_type = other RNA
ttatgacatgggctgtctag

SEQ ID NO: 2499 - RNA, 20 nt, synthetic construct
  source 1..20: mol_type = other RNA
gacaattcagtgtcatatat

SEQ ID NO: 2500 - RNA, 20 nt, synthetic construct
  source 1..20: mol_type = other RNA
atatatgacactgaattgtc

SEQ ID NO: 2501 - RNA, 20 nt, synthetic construct
  source 1..20: mol_type = other RNA
gtgtcatatatggaaagcat

SEQ ID NO: 2502 - RNA, 20 nt, synthetic construct
  source 1..20: mol_type = other RNA
agagttgacagatggcaatg

SEQ ID NO: 2503 - RNA, 20 nt, synthetic construct
  source 1..20: mol_type = other RNA
agccattgccatctgtcaac

SEQ ID NO: 2504 - RNA, 20 nt, synthetic construct
  source 1..20: mol_type = other RNA
aacgggcagagataacacag

SEQ ID NO: 2505 - RNA, 20 nt, synthetic construct
  source 1..20: mol_type = other RNA
gtggaggggaaggagagaga

SEQ ID NO: 2506 - RNA, 20 nt, synthetic construct
  source 1..20: mol_type = other RNA
cctccacagaatcaagtatc

SEQ ID NO: 2507 - RNA, 20 nt, synthetic construct
  source 1..20: mol_type = other RNA
aacatcacagagctgtcagg

SEQ ID NO: 2508 - RNA, 20 nt, synthetic construct
  source 1..20: mol_type = other RNA
tgcagagggttagcaggtgg

SEQ ID NO: 2509 - RNA, 20 nt, synthetic construct
  source 1..20: mol_type = other RNA
tccccgatccctggtgacca

SEQ ID NO: 2510 - RNA, 20 nt, synthetic construct
  source 1..20: mol_type = other RNA
ccttcctgcaagccacaccc

SEQ ID NO: 2511 - RNA, 20 nt, synthetic construct
  source 1..20: mol_type = other RNA
ctatttgctagtccagattt

SEQ ID NO: 2512 - RNA, 20 nt, synthetic construct
  source 1..20: mol_type = other RNA
tagtggccagcgttgctcac

SEQ ID NO: 2513 - RNA, 20 nt, synthetic construct
  source 1..20: mol_type = other RNA
tgctagatcccacaggtctc

SEQ ID NO: 2514 - RNA, 20 nt, synthetic construct
  source 1..20: mol_type = other RNA
gcatcctcctctaagctttg

SEQ ID NO: 2515 - RNA, 20 nt, synthetic construct
  source 1..20: mol_type = other RNA
tctgcaaagcttagaggagg

SEQ ID NO: 2516 - RNA, 20 nt, synthetic construct
  source 1..20: mol_type = other RNA
ggattcatctgcaaagctta

SEQ ID NO: 2517 - RNA, 20 nt, synthetic construct
  source 1..20: mol_type = other RNA
ctggaggggctgaccatttc

SEQ ID NO: 2518 - RNA, 20 nt, synthetic construct
  source 1..20: mol_type = other RNA
tttctctggaggggctgacc

SEQ ID NO: 2519 - RNA, 20 nt, synthetic construct
  source 1..20: mol_type = other RNA
tcttagtactttacactaat

SEQ ID NO: 2520 - RNA, 20 nt, synthetic construct
  source 1..20: mol_type = other RNA
cccgcccactacggctgtgt

SEQ ID NO: 2521 - RNA, 20 nt, synthetic construct
  source 1..20: mol_type = other RNA
tatatcagaacacagccgta

SEQ ID NO: 2522 - RNA, 20 nt, synthetic construct
  source 1..20: mol_type = other RNA
tcatatatcagaacacagcc

SEQ ID NO: 2523 - RNA, 20 nt, synthetic construct
  source 1..20: mol_type = other RNA
gatatatgaagaatggcggc

SEQ ID NO: 2524 - RNA, 20 nt, synthetic construct
  source 1..20: mol_type = other RNA
aaaacagagttggagtcttg

SEQ ID NO: 2525 - RNA, 20 nt, synthetic construct
  source 1..20: mol_type = other RNA
tagcttctaagagtataaaa

SEQ ID NO: 2526 - RNA, 20 nt, synthetic construct
  source 1..20: mol_type = other RNA
tgtgtggcaaagttcttagc

SEQ ID NO: 2527 - RNA, 20 nt, synthetic construct
  source 1..20: mol_type = other RNA
aaatttggttcatgtgtggc

SEQ ID NO: 2528 - RNA, 20 nt, synthetic construct
  source 1..20: mol_type = other RNA
tccctagtgtatctacttcc

SEQ ID NO: 2529 - RNA, 20 nt, synthetic construct
  source 1..20: mol_type = other RNA
ctagtgtatctacttccttt

SEQ ID NO: 2530 - RNA, 20 nt, synthetic construct
  source 1..20: mol_type = other RNA
aaaggaagtagatacactag

SEQ ID NO: 2531 - RNA, 20 nt, synthetic construct
  source 1..20: mol_type = other RNA
tctgctacctcttgtgtata

SEQ ID NO: 2532 - RNA, 20 nt, synthetic construct
  source 1..20: mol_type = other RNA
agtctgcttgttccaagctc

SEQ ID NO: 2533 - RNA, 20 nt, synthetic construct
  source 1..20: mol_type = other RNA
gagcttggaacaagcagact

SEQ ID NO: 2534 - RNA, 20 nt, synthetic construct
  source 1..20: mol_type = other RNA
aagctcagaaggtaactgca

SEQ ID NO: 2535 - RNA, 20 nt, synthetic construct
  source 1..20: mol_type = other RNA
ctgctaacatcgaggtgtgt

SEQ ID NO: 2536 - RNA, 20 nt, synthetic construct
  source 1..20: mol_type = other RNA
taaaactgactgtagttgtc

SEQ ID NO: 2537 - RNA, 20 nt, synthetic construct
  source 1..20: mol_type = other RNA
ttcccaggatgccttcaacg

SEQ ID NO: 2538 - RNA, 20 nt, synthetic construct
  source 1..20: mol_type = other RNA
gcccgttgaaggcatcctgg

SEQ ID NO: 2539 - RNA, 20 nt, synthetic construct
  source 1..20: mol_type = other RNA
caggatgccttcaacgggca

SEQ ID NO: 2540 - RNA, 20 nt, synthetic construct
  source 1..20: mol_type = other RNA
acgggcagaatcggccatct

SEQ ID NO: 2541 - RNA, 20 nt, synthetic construct
  source 1..20: mol_type = other RNA
caagaagctcccttagtgag

SEQ ID NO: 2542 - RNA, 20 nt, synthetic construct
  source 1..20: mol_type = other RNA
tgagaacacacagcattatt

SEQ ID NO: 2543 - RNA, 20 nt, synthetic construct
  source 1..20: mol_type = other RNA
tgctctgtttgcagaccatt

SEQ ID NO: 2544 - RNA, 20 nt, synthetic construct
  source 1..20: mol_type = other RNA
aaatggtctgcaaacagagc

SEQ ID NO: 2545 - RNA, 20 nt, synthetic construct
  source 1..20: mol_type = other RNA
aaggtaagcctgtcataact

SEQ ID NO: 2546 - RNA, 20 nt, synthetic construct
  source 1..20: mol_type = other RNA
atttggggtctgtaccttaa

SEQ ID NO: 2547 - RNA, 20 nt, synthetic construct
  source 1..20: mol_type = other RNA
ataaagtggttacatttgta

SEQ ID NO: 2548 - RNA, 20 nt, synthetic construct
  source 1..20: mol_type = other RNA
atgtcaatatataaacctcc

SEQ ID NO: 2549 - RNA, 20 nt, synthetic construct
  source 1..20: mol_type = other RNA
ttttaccagctgccaaatat

SEQ ID NO: 2550 - RNA, 20 nt, synthetic construct
  source 1..20: mol_type = other RNA
tatggtgggatatttggcag

SEQ ID NO: 2551 - RNA, 20 nt, synthetic construct
  source 1..20: mol_type = other RNA
tcaatggagggacagatttt

SEQ ID NO: 2552 - RNA, 20 nt, synthetic construct
  source 1..20: mol_type = other RNA
gcaatccaaacattcatcaa

SEQ ID NO: 2553 - RNA, 20 nt, synthetic construct
  source 1..20: mol_type = other RNA
aggggttcagcaatccaaac

SEQ ID NO: 2554 - RNA, 20 nt, synthetic construct
  source 1..20: mol_type = other RNA
tccaggggttcagcaatcca

SEQ ID NO: 2555 - RNA, 20 nt, synthetic construct
  source 1..20: mol_type = other RNA
gtttgctcttattgaatttc

SEQ ID NO: 2556 - RNA, 20 nt, synthetic construct
  source 1..20: mol_type = other RNA
ataagagcaaacagaagtgt

SEQ ID NO: 2557 - RNA, 20 nt, synthetic construct
  source 1..20: mol_type = other RNA
cttagctctccccgctccac

SEQ ID NO: 2558 - RNA, 20 nt, synthetic construct
  source 1..20: mol_type = other RNA
ggctgcgctgcctcctgcct

SEQ ID NO: 2559 - RNA, 20 nt, synthetic construct
  source 1..20: mol_type = other RNA
caccccaccacatgtctggg

SEQ ID NO: 2560 - RNA, 20 nt, synthetic construct
  source 1..20: mol_type = other RNA
tataccctgttcagtcttta

SEQ ID NO: 2561 - RNA, 20 nt, synthetic construct
  source 1..20: mol_type = other RNA
gactcagtaaagactgaaca

SEQ ID NO: 2562 - RNA, 20 nt, synthetic construct
  source 1..20: mol_type = other RNA
gtctttactgagtcagaagc

SEQ ID NO: 2563 - RNA, 20 nt, synthetic construct
  source 1..20: mol_type = other RNA
gtaagaagctctgctgtaaa

SEQ ID NO: 2564 - RNA, 20 nt, synthetic construct
  source 1..20: mol_type = other RNA
tacggaaaagcgtgctgctg

SEQ ID NO: 2565 - RNA, 20 nt, synthetic construct
  source 1..20: mol_type = other RNA
aggatgaggctggagctggc

SEQ ID NO: 2566 - RNA, 20 nt, synthetic construct
  source 1..20: mol_type = other RNA
atatcattagtacctctttg

SEQ ID NO: 2567 - RNA, 20 nt, synthetic construct
  source 1..20: mol_type = other RNA
taggaatttatcctaaggaa

SEQ ID NO: 2568 - RNA, 20 nt, synthetic construct
  source 1..20: mol_type = other RNA
ttaggataaattcctaagaa

SEQ ID NO: 2569 - RNA, 20 nt, synthetic construct
  source 1..20: mol_type = other RNA
taagaaatcaaatagctagg

SEQ ID NO: 2570 - RNA, 20 nt, synthetic construct
  source 1..20: mol_type = other RNA
cagtttgctactgactagag

SEQ ID NO: 2571 - RNA, 20 nt, synthetic construct
  source 1..20: mol_type = other RNA
ggctgtttttgtacctttaa

SEQ ID NO: 2572 - RNA, 20 nt, synthetic construct
  source 1..20: mol_type = other RNA
ccctgattagaaatgacgtc

SEQ ID NO: 2573 - RNA, 20 nt, synthetic construct
  source 1..20: mol_type = other RNA
aatcagggagaaaaaatgag

SEQ ID NO: 2574 - RNA, 20 nt, synthetic construct
  source 1..20: mol_type = other RNA
gtaactcattttttctccct

SEQ ID NO: 2575 - RNA, 20 nt, synthetic construct
  source 1..20: mol_type = other RNA
aataccgtttattccgtaac

SEQ ID NO: 2576 - RNA, 20 nt, synthetic construct
  source 1..20: mol_type = other RNA
ccagaaggctagcctattgt

SEQ ID NO: 2577 - RNA, 20 nt, synthetic construct
  source 1..20: mol_type = other RNA
ggagaaaaataacctcactc

SEQ ID NO: 2578 - RNA, 20 nt, synthetic construct
  source 1..20: mol_type = other RNA
actgggatttacttttgtat

SEQ ID NO: 2579 - RNA, 20 nt, synthetic construct
  source 1..20: mol_type = other RNA
tgattttgtactgtgcttag

SEQ ID NO: 2580 - RNA, 20 nt, synthetic construct
  source 1..20: mol_type = other RNA
aagcacagtacaaaatcaag

SEQ ID NO: 2581 - RNA, 20 nt, synthetic construct
  source 1..20: mol_type = other RNA
tgacttcttgattttgtact

SEQ ID NO: 2582 - RNA, 20 nt, synthetic construct
  source 1..20: mol_type = other RNA
tggagtcaaacttatcagcc

SEQ ID NO: 2583 - RNA, 20 nt, synthetic construct
  source 1..20: mol_type = other RNA
atagaaaattttaattttca

SEQ ID NO: 2584 - RNA, 20 nt, synthetic construct
  source 1..20: mol_type = other RNA
atggaaaaaaatacaataaa

SEQ ID NO: 2585 - RNA, 20 nt, synthetic construct
  source 1..20: mol_type = other RNA
agtttgttgattgatttttg

SEQ ID NO: 2586 - RNA, 20 nt, synthetic construct
  source 1..20: mol_type = other RNA
ttttggctgtggagcttttg

SEQ ID NO: 2587 - RNA, 20 nt, synthetic construct
  source 1..20: mol_type = other RNA
ttttttcattttggctgtgg

SEQ ID NO: 2588 - RNA, 20 nt, synthetic construct
  source 1..20: mol_type = other RNA
aagacaaacaaatgtagata

SEQ ID NO: 2589 - RNA, 20 nt, synthetic construct
  source 1..20: mol_type = other RNA
ttaagttaaacaattatcta

SEQ ID NO: 2590 - RNA, 20 nt, synthetic construct
  source 1..20: mol_type = other RNA
caaatataccctttctcctc

SEQ ID NO: 2591 - RNA, 20 nt, synthetic construct
  source 1..20: mol_type = other RNA
cctccttctgggcacttggt

SEQ ID NO: 2592 - RNA, 20 nt, synthetic construct
  source 1..20: mol_type = other RNA
gggcacttggtgtgattgca

SEQ ID NO: 2593 - RNA, 20 nt, synthetic construct
  source 1..20: mol_type = other RNA
tacatttgaccttaggtgtg

SEQ ID NO: 2594 - RNA, 20 nt, synthetic construct
  source 1..20: mol_type = other RNA
cctaagcgagacacatgacc

SEQ ID NO: 2595 - RNA, 20 nt, synthetic construct
  source 1..20: mol_type = other RNA
ttctcctaagcgagacacat

SEQ ID NO: 2596 - RNA, 20 nt, synthetic construct
  source 1..20: mol_type = other RNA
catttccttctcctaagcga

SEQ ID NO: 2597 - RNA, 20 nt, synthetic construct
  source 1..20: mol_type = other RNA
gttcacatttccttctccta

SEQ ID NO: 2598 - RNA, 20 nt, synthetic construct
  source 1..20: mol_type = other RNA
acacaaaagtgacccacaac

SEQ ID NO: 2599 - RNA, 20 nt, synthetic construct
  source 1..20: mol_type = other RNA
gtcagcctcagtgttcagca

SEQ ID NO: 2600 - RNA, 20 nt, synthetic construct
  source 1..20: mol_type = other RNA
gaacattgctgaacactgag

SEQ ID NO: 2601 - RNA, 20 nt, synthetic construct
  source 1..20: mol_type = other RNA
gcaatgttctgaatgatggt

SEQ ID NO: 2602 - RNA, 20 nt, synthetic construct
  source 1..20: mol_type = other RNA
gaatgatggttgctttatca

SEQ ID NO: 2603 - RNA, 20 nt, synthetic construct
  source 1..20: mol_type = other RNA
ttaccctcaccccagaacca

SEQ ID NO: 2604 - RNA, 20 nt, synthetic construct
  source 1..20: mol_type = other RNA
ggggtgagggtaatgaagta

SEQ ID NO: 2605 - RNA, 20 nt, synthetic construct
  source 1..20: mol_type = other RNA
ctacttcattaccctcaccc

SEQ ID NO: 2606 - RNA, 20 nt, synthetic construct
  source 1..20: mol_type = other RNA
gtctcacctcacatgtccat

SEQ ID NO: 2607 - RNA, 20 nt, synthetic construct
  source 1..20: mol_type = other RNA
agcccctgagatttggggcg

SEQ ID NO: 2608 - RNA, 20 nt, synthetic construct
  source 1..20: mol_type = other RNA
agcacatgcacgccccaaat

SEQ ID NO: 2609 - RNA, 20 nt, synthetic construct
  source 1..20: mol_type = other RNA
gcttccagcacatgcacgcc

SEQ ID NO: 2610 - RNA, 20 nt, synthetic construct
  source 1..20: mol_type = other RNA
gatggattcctccagcactg

SEQ ID NO: 2611 - RNA, 20 nt, synthetic construct
  source 1..20: mol_type = other RNA
cacgagcagtgctggaggaa

SEQ ID NO: 2612 - RNA, 20 nt, synthetic construct
  source 1..20: mol_type = other RNA
tccagcactgctcgtgggaa

SEQ ID NO: 2613 - RNA, 20 nt, synthetic construct
  source 1..20: mol_type = other RNA
agataaagggcacatgaatg

SEQ ID NO: 2614 - RNA, 20 nt, synthetic construct
  source 1..20: mol_type = other RNA
tgtgccctttatctcgaaat

SEQ ID NO: 2615 - RNA, 20 nt, synthetic construct
  source 1..20: mol_type = other RNA
tggaagtggaatttcgagat

SEQ ID NO: 2616 - RNA, 20 nt, synthetic construct
  source 1..20: mol_type = other RNA
taaattcctggaagtggaat

SEQ ID NO: 2617 - RNA, 20 nt, synthetic construct
  source 1..20: mol_type = other RNA
acttccaggaatttatgaaa

SEQ ID NO: 2618 - RNA, 20 nt, synthetic construct
  source 1..20: mol_type = other RNA
aggaatttatgaaacagata

SEQ ID NO: 2619 - RNA, 20 nt, synthetic construct
  source 1..20: mol_type = other RNA
gtcttttgctattgcaatcc

SEQ ID NO: 2620 - RNA, 20 nt, synthetic construct
  source 1..20: mol_type = other RNA
gttggttgtttctgtctttt

SEQ ID NO: 2621 - RNA, 20 nt, synthetic construct
  source 1..20: mol_type = other RNA
tattggttggtgtttccgtt

SEQ ID NO: 2622 - RNA, 20 nt, synthetic construct
  source 1..20: mol_type = other RNA
caatgtctttagccaatttc

SEQ ID NO: 2623 - RNA, 20 nt, synthetic construct
  source 1..20: mol_type = other RNA
atgtatgtttcacaatgtct

SEQ ID NO: 2624 - RNA, 20 nt, synthetic construct
  source 1..20: mol_type = other RNA
ttctatgtatgtttcacaat

SEQ ID NO: 2625 - RNA, 20 nt, synthetic construct
  source 1..20: mol_type = other RNA
ggttgcagattatttcattc

SEQ ID NO: 2626 - RNA, 20 nt, synthetic construct
  source 1..20: mol_type = other RNA
gagattagggctaggttaag

SEQ ID NO: 2627 - RNA, 20 nt, synthetic construct
  source 1..20: mol_type = other RNA
gagatagtctacttttataa

SEQ ID NO: 2628 - RNA, 20 nt, synthetic construct
  source 1..20: mol_type = other RNA
tggggctgttataacaagtt

SEQ ID NO: 2629 - RNA, 20 nt, synthetic construct
  source 1..20: mol_type = other RNA
acaaatttgctggcttcaaa

SEQ ID NO: 2630 - RNA, 20 nt, synthetic construct
  source 1..20: mol_type = other RNA
aataacaaaaacgtattctc

SEQ ID NO: 2631 - RNA, 20 nt, synthetic construct
  source 1..20: mol_type = other RNA
ataactgcaagagaatacgt

SEQ ID NO: 2632 - RNA, 20 nt, synthetic construct
  source 1..20: mol_type = other RNA
ggcttccataactgcaagag

SEQ ID NO: 2633 - RNA, 20 nt, synthetic construct
  source 1..20: mol_type = other RNA
cttgcagttatggaagccag

SEQ ID NO: 2634 - RNA, 20 nt, synthetic construct
  source 1..20: mol_type = other RNA
atacttctggcttccataac

SEQ ID NO: 2635 - RNA, 20 nt, synthetic construct
  source 1..20: mol_type = other RNA
ttccatacttctggcttcca

SEQ ID NO: 2636 - RNA, 20 nt, synthetic construct
  source 1..20: mol_type = other RNA
tcccctagagctttgggaga

SEQ ID NO: 2637 - RNA, 20 nt, synthetic construct
  source 1..20: mol_type = other RNA
ttgcttcttccagctccttt

SEQ ID NO: 2638 - RNA, 20 nt, synthetic construct
  source 1..20: mol_type = other RNA
tccagctcctttgggggctc

SEQ ID NO: 2639 - RNA, 20 nt, synthetic construct
  source 1..20: mol_type = other RNA
agctcctttgggggctcctg

SEQ ID NO: 2640 - RNA, 20 nt, synthetic construct
  source 1..20: mol_type = other RNA
ttggcttatgtcggcacagc

SEQ ID NO: 2641 - RNA, 20 nt, synthetic construct
  source 1..20: mol_type = other RNA
gtgtctcaagtatctctccc

SEQ ID NO: 2642 - RNA, 20 nt, synthetic construct
  source 1..20: mol_type = other RNA
cttctgatatcagtcattgg

SEQ ID NO: 2643 - RNA, 20 nt, synthetic construct
  source 1..20: mol_type = other RNA
gatatcagtcattggattta

SEQ ID NO: 2644 - RNA, 20 nt, synthetic construct
  source 1..20: mol_type = other RNA
aaataaggtcacattcaaaa

SEQ ID NO: 2645 - RNA, 20 nt, synthetic construct
  source 1..20: mol_type = other RNA
aaagtaccaggggttagtct

SEQ ID NO: 2646 - RNA, 20 nt, synthetic construct
  source 1..20: mol_type = other RNA
acccactaccgtgggtaaca

SEQ ID NO: 2647 - RNA, 20 nt, synthetic construct
  source 1..20: mol_type = other RNA
gagggaaaaccactgttacc

SEQ ID NO: 2648 - RNA, 20 nt, synthetic construct
  source 1..20: mol_type = other RNA
ctcagaaggtggtggttcag

SEQ ID NO: 2649 - RNA, 20 nt, synthetic construct
  source 1..20: mol_type = other RNA
tcccactcctgaaccaccac

SEQ ID NO: 2650 - RNA, 20 nt, synthetic construct
  source 1..20: mol_type = other RNA
tcttcctcccactcctgaac

SEQ ID NO: 2651 - RNA, 20 nt, synthetic construct
  source 1..20: mol_type = other RNA
ggagtgggaggaagatgaac

SEQ ID NO: 2652 - RNA, 20 nt, synthetic construct
  source 1..20: mol_type = other RNA
ctgtatatcctttcaaacta

SEQ ID NO: 2653 - RNA, 20 nt, synthetic construct
  source 1..20: mol_type = other RNA
aactattcacgttttaaaaa

SEQ ID NO: 2654 - RNA, 20 nt, synthetic construct
  source 1..20: mol_type = other RNA
cgttttaaaaaaaacatttt

SEQ ID NO: 2655 - RNA, 20 nt, synthetic construct
  source 1..20: mol_type = other RNA
atttttttaaatttacatga

SEQ ID NO: 2656 - RNA, 20 nt, synthetic construct
  source 1..20: mol_type = other RNA
tgtaaatttaaaaaaattga

SEQ ID NO: 2657 - RNA, 20 nt, synthetic construct
  source 1..20: mol_type = other RNA
cacaaaaagatgccccctcc

SEQ ID NO: 2658 - RNA, 20 nt, synthetic construct
  source 1..20: mol_type = other RNA
acattttgaacgggcatact

SEQ ID NO: 2659 - RNA, 20 nt, synthetic construct
  source 1..20: mol_type = other RNA
aaatgttgaaatgtacactc

SEQ ID NO: 2660 - RNA, 20 nt, synthetic construct
  source 1..20: mol_type = other RNA
ttcctcccccacctccctca

SEQ ID NO: 2661 - RNA, 20 nt, synthetic construct
  source 1..20: mol_type = other RNA
tctcttgccatgtgattgat

SEQ ID NO: 2662 - RNA, 20 nt, synthetic construct
  source 1..20: mol_type = other RNA
ttcccttcaccccacaagca

SEQ ID NO: 2663 - RNA, 20 nt, synthetic construct
  source 1..20: mol_type = other RNA
gggtcaacacccatcctttt

SEQ ID NO: 2664 - RNA, 20 nt, synthetic construct
  source 1..20: mol_type = other RNA
agaggctggaagaggccact

SEQ ID NO: 2665 - RNA, 20 nt, synthetic construct
  source 1..20: mol_type = other RNA
cagctcccagaaccatggag

SEQ ID NO: 2666 - RNA, 20 nt, synthetic construct
  source 1..20: mol_type = other RNA
ttgactgtagctgtcagcaa

SEQ ID NO: 2667 - RNA, 20 nt, synthetic construct
  source 1..20: mol_type = other RNA
ctttgctggtaaccacttga

SEQ ID NO: 2668 - RNA, 20 nt, synthetic construct
  source 1..20: mol_type = other RNA
gatcatgttgcttatattgt

SEQ ID NO: 2669 - RNA, 20 nt, synthetic construct
  source 1..20: mol_type = other RNA
tcaggatcgtccaccgtgta

SEQ ID NO: 2670 - RNA, 20 nt, synthetic construct
  source 1..20: mol_type = other RNA
gcacccctagcacctgccgt

SEQ ID NO: 2671 - RNA, 20 nt, synthetic construct
  source 1..20: mol_type = other RNA
tatggaaacaacgccttccg

SEQ ID NO: 2672 - RNA, 20 nt, synthetic construct
  source 1..20: mol_type = other RNA
ccttttcatcctcctgcctg

SEQ ID NO: 2673 - RNA, 20 nt, synthetic construct
  source 1..20: mol_type = other RNA
agtccccttatttcctatgg

SEQ ID NO: 2674 - RNA, 20 nt, synthetic construct
  source 1..20: mol_type = other RNA
ataggaaataaggggactag

SEQ ID NO: 2675 - RNA, 20 nt, synthetic construct
  source 1..20: mol_type = other RNA
ttttacacaccatgttcaag

SEQ ID NO: 2676 - RNA, 20 nt, synthetic construct
  source 1..20: mol_type = other RNA
aggtcatgtcccacacaatc

SEQ ID NO: 2677 - RNA, 20 nt, synthetic construct
  source 1..20: mol_type = other RNA
atttgcaaagattcctttta

SEQ ID NO: 2678 - RNA, 20 nt, synthetic construct
  source 1..20: mol_type = other RNA
ctccgcccacatcctcacca

SEQ ID NO: 2679 - RNA, 20 nt, synthetic construct
  source 1..20: mol_type = other RNA
caccttctctccgcccacat

SEQ ID NO: 2680 - RNA, 20 nt, synthetic construct
  source 1..20: mol_type = other RNA
cctaccctattctcaccttc

SEQ ID NO: 2681 - RNA, 20 nt, synthetic construct
  source 1..20: mol_type = other RNA
tgtcctactgtttcccctac

SEQ ID NO: 2682 - RNA, 20 nt, synthetic construct
  source 1..20: mol_type = other RNA
cgtactcaaaaccaatggta

SEQ ID NO: 2683 - RNA, 20 nt, synthetic construct
  source 1..20: mol_type = other RNA
ggttttaagtttgcaaagac

SEQ ID NO: 2684 - RNA, 20 nt, synthetic construct
  source 1..20: mol_type = other RNA
aatggtcttgcagtttgaaa

SEQ ID NO: 2685 - RNA, 20 nt, synthetic construct
  source 1..20: mol_type = other RNA
aactgcaagaccattggaac

SEQ ID NO: 2686 - RNA, 20 nt, synthetic construct
  source 1..20: mol_type = other RNA
gacggttccaatggtcttgc

SEQ ID NO: 2687 - RNA, 20 nt, synthetic construct
  source 1..20: mol_type = other RNA
ctaagggtacagttctgctc

SEQ ID NO: 2688 - RNA, 20 nt, synthetic construct
  source 1..20: mol_type = other RNA
gctcttaagtgctggccctt

SEQ ID NO: 2689 - RNA, 20 nt, synthetic construct
  source 1..20: mol_type = other RNA
atcttctcagtgtgtttgac

SEQ ID NO: 2690 - RNA, 20 nt, synthetic construct
  source 1..20: mol_type = other RNA
cagtgtgtttgacaaaggcc

SEQ ID NO: 2691 - RNA, 20 nt, synthetic construct
  source 1..20: mol_type = other RNA
gtgacttgctggaggttggc

SEQ ID NO: 2692 - RNA, 20 nt, synthetic construct
  source 1..20: mol_type = other RNA
ttgttattctgtgacttgct

SEQ ID NO: 2693 - RNA, 20 nt, synthetic construct
  source 1..20: mol_type = other RNA
gtgctgtcagacttcattgt

SEQ ID NO: 2694 - RNA, 20 nt, synthetic construct
  source 1..20: mol_type = other RNA
gccgggcccaccttttcagt

SEQ ID NO: 2695 - RNA, 20 nt, synthetic construct
  source 1..20: mol_type = other RNA
ctggcagtgagggtttctgt

SEQ ID NO: 2696 - RNA, 20 nt, synthetic construct
  source 1..20: mol_type = other RNA
ttctctggcagtgagggttt

SEQ ID NO: 2697 - RNA, 20 nt, synthetic construct
  source 1..20: mol_type = other RNA
gggctggctgcgcctctgtg

SEQ ID NO: 2698 - RNA, 20 nt, synthetic construct
  source 1..20: mol_type = other RNA
ctgtcagatttgccaagtca

SEQ ID NO: 2699 - RNA, 20 nt, synthetic construct
  source 1..20: mol_type = other RNA
taaggctccctagttctgtg

SEQ ID NO: 2700 - RNA, 20 nt, synthetic construct
  source 1..20: mol_type = other RNA
tctcaccatgcacagaacta

SEQ ID NO: 2701 - RNA, 20 nt, synthetic construct
  source 1..20: mol_type = other RNA
gtgcatggtgagatgaaaat

SEQ ID NO: 2702 - RNA, 20 nt, synthetic construct
  source 1..20: mol_type = other RNA
gttcagggtctgagcctgga

SEQ ID NO: 2703 - RNA, 20 nt, synthetic construct
  source 1..20: mol_type = other RNA
aaagtatagcaccattcact

SEQ ID NO: 2704 - RNA, 20 nt, synthetic construct
  source 1..20: mol_type = other RNA
gggaaaataaatcttaaacc

SEQ ID NO: 2705 - RNA, 20 nt, synthetic construct
  source 1..20: mol_type = other RNA
gtgttaattagtcatgttga

SEQ ID NO: 2706 - RNA, 20 nt, synthetic construct
  source 1..20: mol_type = other RNA
cctcaacatgactaattaac

SEQ ID NO: 2707 - RNA, 20 nt, synthetic construct
  source 1..20: mol_type = other RNA
caaattccttctctgcatta

SEQ ID NO: 2708 - RNA, 20 nt, synthetic construct
  source 1..20: mol_type = other RNA
ttctctgcattacaataact

SEQ ID NO: 2709 - RNA, 20 nt, synthetic construct
  source 1..20: mol_type = other RNA
tagttattgtaatgcagaga

SEQ ID NO: 2710 - RNA, 20 nt, synthetic construct
  source 1..20: mol_type = other RNA
ctgcattacaataactatga

SEQ ID NO: 2711 - RNA, 20 nt, synthetic construct
  source 1..20: mol_type = other RNA
tatacaaccaataccaaggg

SEQ ID NO: 2712 - RNA, 20 nt, synthetic construct
  source 1..20: mol_type = other RNA
atatgtctccaagcattaaa

SEQ ID NO: 2713 - RNA, 20 nt, synthetic construct
  source 1..20: mol_type = other RNA
tctcgggcctcagtttcccc

SEQ ID NO: 2714 - RNA, 20 nt, synthetic construct
  source 1..20: mol_type = other RNA
tctcttacatggggggaaac

SEQ ID NO: 2715 - RNA, 20 nt, synthetic construct
  source 1..20: mol_type = other RNA
gtgaagttaaactcagtaaa

SEQ ID NO: 2716 - RNA, 20 nt, synthetic construct
  source 1..20: mol_type = other RNA
ccagaagtacagggtgcatt

SEQ ID NO: 2717 - RNA, 20 nt, synthetic construct
  source 1..20: mol_type = other RNA
agagcttagtatttcccaat

SEQ ID NO: 2718 - RNA, 20 nt, synthetic construct
  source 1..20: mol_type = other RNA
tcaagatccaagcttatgca

SEQ ID NO: 2719 - RNA, 20 nt, synthetic construct
  source 1..20: mol_type = other RNA
gatgggtctagatgagaacc

SEQ ID NO: 2720 - RNA, 20 nt, synthetic construct
  source 1..20: mol_type = other RNA
catctagacccatctgaaat

SEQ ID NO: 2721 - RNA, 20 nt, synthetic construct
  source 1..20: mol_type = other RNA
atacaaatagggagacatat

SEQ ID NO: 2722 - RNA, 20 nt, synthetic construct
  source 1..20: mol_type = other RNA
tgtttaatattactgcaaga

SEQ ID NO: 2723 - RNA, 20 nt, synthetic construct
  source 1..20: mol_type = other RNA
ctacgatgctacaaaagaaa

SEQ ID NO: 2724 - RNA, 20 nt, synthetic construct
  source 1..20: mol_type = other RNA
tttgtagcatcgtagagaaa

SEQ ID NO: 2725 - RNA, 20 nt, synthetic construct
  source 1..20: mol_type = other RNA
gaaatagagccagtggcaga

SEQ ID NO: 2726 - RNA, 20 nt, synthetic construct
  source 1..20: mol_type = other RNA
gaaaatctccacagaaatgt

SEQ ID NO: 2727 - RNA, 20 nt, synthetic construct
  source 1..20: mol_type = other RNA
cccactgccaaacagctccc

SEQ ID NO: 2728 - RNA, 20 nt, synthetic construct
  source 1..20: mol_type = other RNA
agtggcttaaaaatgctttc

SEQ ID NO: 2729 - RNA, 20 nt, synthetic construct
  source 1..20: mol_type = other RNA
ttgagaaatacacgatccgc

SEQ ID NO: 2730 - RNA, 20 nt, synthetic construct
  source 1..20: mol_type = other RNA
cagtccaatctccaggctct

SEQ ID NO: 2731 - RNA, 20 nt, synthetic construct
  source 1..20: mol_type = other RNA
aaagggttcgagattctgat

SEQ ID NO: 2732 - RNA, 20 nt, synthetic construct
  source 1..20: mol_type = other RNA
tggaatcagaatctcgaacc

SEQ ID NO: 2733 - RNA, 20 nt, synthetic construct
  source 1..20: mol_type = other RNA
agattctgattccaagaagg

SEQ ID NO: 2734 - RNA, 20 nt, synthetic construct
  source 1..20: mol_type = other RNA
gattccaagaaggtgctgag

SEQ ID NO: 2735 - RNA, 20 nt, synthetic construct
  source 1..20: mol_type = other RNA
aagaaggtgctgagcatcca

SEQ ID NO: 2736 - RNA, 20 nt, synthetic construct
  source 1..20: mol_type = other RNA
tctagggatcaacatcatca

SEQ ID NO: 2737 - RNA, 20 nt, synthetic construct
  source 1..20: mol_type = other RNA
caactcaccaatcatcatgg

SEQ ID NO: 2738 - RNA, 20 nt, synthetic construct
  source 1..20: mol_type = other RNA
gctggttcttttcttcggct

SEQ ID NO: 2739 - RNA, 20 nt, synthetic construct
  source 1..20: mol_type = other RNA
gaatctcccatgatgattgg

SEQ ID NO: 2740 - RNA, 20 nt, synthetic construct
  source 1..20: mol_type = other RNA
gcagggttcagaatctccca

SEQ ID NO: 2741 - RNA, 20 nt, synthetic construct
  source 1..20: mol_type = other RNA
tttctgcagggttcagaatc

SEQ ID NO: 2742 - RNA, 20 nt, synthetic construct
  source 1..20: mol_type = other RNA
gaaccctgcagaaaagaaaa

SEQ ID NO: 2743 - RNA, 20 nt, synthetic construct
  source 1..20: mol_type = other RNA
ctaaccgtatgaactttaac

SEQ ID NO: 2744 - RNA, 20 nt, synthetic construct
  source 1..20: mol_type = other RNA
tacggttagagaaaaggttt

SEQ ID NO: 2745 - RNA, 20 nt, synthetic construct
  source 1..20: mol_type = other RNA
atgctgacttgtgttctgca

SEQ ID NO: 2746 - RNA, 20 nt, synthetic construct
  source 1..20: mol_type = other RNA
gcaatttaaacatgtcttca

SEQ ID NO: 2747 - RNA, 20 nt, synthetic construct
  source 1..20: mol_type = other RNA
tctggcaacttaatgcaatg

SEQ ID NO: 2748 - RNA, 20 nt, synthetic construct
  source 1..20: mol_type = other RNA
tgattatgtaaaacatgtac

SEQ ID NO: 2749 - RNA, 20 nt, synthetic construct
  source 1..20: mol_type = other RNA
accccacatctgactccaag

SEQ ID NO: 2750 - RNA, 20 nt, synthetic construct
  source 1..20: mol_type = other RNA
ctgactaaatgagatcatag

SEQ ID NO: 2751 - RNA, 20 nt, synthetic construct
  source 1..20: mol_type = other RNA
atgatctcatttagtcagtg

SEQ ID NO: 2752 - RNA, 20 nt, synthetic construct
  source 1..20: mol_type = other RNA
cacatgggtgcagagtagca

SEQ ID NO: 2753 - RNA, 20 nt, synthetic construct
  source 1..20: mol_type = other RNA
cgttgggcactgtgtgagcc

SEQ ID NO: 2754 - RNA, 20 nt, synthetic construct
  source 1..20: mol_type = other RNA
gacccaggagtgacccagag

SEQ ID NO: 2755 - RNA, 20 nt, synthetic construct
  source 1..20: mol_type = other RNA
ccaagtgtgtaagccaaagg

SEQ ID NO: 2756 - RNA, 20 nt, synthetic construct
  source 1..20: mol_type = other RNA
gaacgattcgccaagtgtgt

SEQ ID NO: 2757 - RNA, 20 nt, synthetic construct
  source 1..20: mol_type = other RNA
gaatactcaccgtgtgccat

SEQ ID NO: 2758 - RNA, 20 nt, synthetic construct
  source 1..20: mol_type = other RNA
gaaaatgggccaggcacagt

SEQ ID NO: 2759 - RNA, 20 nt, synthetic construct
  source 1..20: mol_type = other RNA
agaacagttgttttggagca

SEQ ID NO: 2760 - RNA, 20 nt, synthetic construct
  source 1..20: mol_type = other RNA
tttattcattcattcaatgg

SEQ ID NO: 2761 - RNA, 20 nt, synthetic construct
  source 1..20: mol_type = other RNA
ttcattcaatggttattttg

SEQ ID NO: 2762 - RNA, 20 nt, synthetic construct
  source 1..20: mol_type = other RNA
ttcaatggttattttgtggg

SEQ ID NO: 2763 - RNA, 20 nt, synthetic construct
  source 1..20: mol_type = other RNA
atggttattttgtgggaatc

SEQ ID NO: 2764 - RNA, 20 nt, synthetic construct
  source 1..20: mol_type = other RNA
gcttgccaaaaaatattttc

SEQ ID NO: 2765 - RNA, 20 nt, synthetic construct
  source 1..20: mol_type = other RNA
gctaaataaaaattgaatga

SEQ ID NO: 2766 - RNA, 20 nt, synthetic construct
  source 1..20: mol_type = other RNA
ttcaatttttatttagcgga

SEQ ID NO: 2767 - RNA, 20 nt, synthetic construct
  source 1..20: mol_type = other RNA
atttttatttagcggaaggc

SEQ ID NO: 2768 - RNA, 20 nt, synthetic construct
  source 1..20: mol_type = other RNA
acctctggttttcccagctc

SEQ ID NO: 2769 - RNA, 20 nt, synthetic construct
  source 1..20: mol_type = other RNA
ttttcttttttttttgagat

SEQ ID NO: 2770 - RNA, 20 nt, synthetic construct
  source 1..20: mol_type = other RNA
tttttttttgagatggagtt

SEQ ID NO: 2771 - RNA, 20 nt, synthetic construct
  source 1..20: mol_type = other RNA
ctcttgttgcccaggctgga

SEQ ID NO: 2772 - RNA, 20 nt, synthetic construct
  source 1..20: mol_type = other RNA
agtggttctcctgcctcagc

SEQ ID NO: 2773 - RNA, 20 nt, synthetic construct
  source 1..20: mol_type = other RNA
tgggaggctgaggcaggaga

SEQ ID NO: 2774 - RNA, 20 nt, synthetic construct
  source 1..20: mol_type = other RNA
cctgcctcagcctcccaaga

SEQ ID NO: 2775 - RNA, 20 nt, synthetic construct
  source 1..20: mol_type = other RNA
ctactaaaaatacaaaaatt

SEQ ID NO: 2776 - RNA, 20 nt, synthetic construct
  source 1..20: mol_type = other RNA
ccacgttggccaggctagtc

SEQ ID NO: 2777 - RNA, 20 nt, synthetic construct
  source 1..20: mol_type = other RNA
agcactttgggaggctgagg

SEQ ID NO: 2778 - RNA, 20 nt, synthetic construct
  source 1..20: mol_type = other RNA
taacattttacatttcagac

SEQ ID NO: 2779 - RNA, 20 nt, synthetic construct
  source 1..20: mol_type = other RNA
cacaactaaattaaaaataa

SEQ ID NO: 2780 - RNA, 20 nt, synthetic construct
  source 1..20: mol_type = other RNA
tatattttgctgcatagatt

SEQ ID NO: 2781 - RNA, 20 nt, synthetic construct
  source 1..20: mol_type = other RNA
gaggttcaaaaccgttttgg

SEQ ID NO: 2782 - RNA, 20 nt, synthetic construct
  source 1..20: mol_type = other RNA
aaaccgttttggccctaagg

SEQ ID NO: 2783 - RNA, 20 nt, synthetic construct
  source 1..20: mol_type = other RNA
acatgagatttggaggggac

SEQ ID NO: 2784 - RNA, 20 nt, synthetic construct
  source 1..20: mol_type = other RNA
aacactgaggaccaaatttc

SEQ ID NO: 2785 - RNA, 20 nt, synthetic construct
  source 1..20: mol_type = other RNA
tcccccatgacccaaacacc

SEQ ID NO: 2786 - RNA, 20 nt, synthetic construct
  source 1..20: mol_type = other RNA
ctcttgcttcttctcttgcc

SEQ ID NO: 2787 - RNA, 20 nt, synthetic construct
  source 1..20: mol_type = other RNA
ctgatggcagaaggtgaagg

SEQ ID NO: 2788 - RNA, 20 nt, synthetic construct
  source 1..20: mol_type = other RNA
ccttctgccatcagtgaaag

SEQ ID NO: 2789 - RNA, 20 nt, synthetic construct
  source 1..20: mol_type = other RNA
ggtgagggccttaagctgct

SEQ ID NO: 2790 - RNA, 20 nt, synthetic construct
  source 1..20: mol_type = other RNA
gcaagctctccaggaagcat

SEQ ID NO: 2791 - RNA, 20 nt, synthetic construct
  source 1..20: mol_type = other RNA
ttgtaaattactcaccttca

SEQ ID NO: 2792 - RNA, 20 nt, synthetic construct
  source 1..20: mol_type = other RNA
ggtattcctttatatagcaa

SEQ ID NO: 2793 - RNA, 20 nt, synthetic construct
  source 1..20: mol_type = other RNA
catttttgcctgaatggcac

SEQ ID NO: 2794 - RNA, 20 nt, synthetic construct
  source 1..20: mol_type = other RNA
ttaatttgctttttggtccg

SEQ ID NO: 2795 - RNA, 20 nt, synthetic construct
  source 1..20: mol_type = other RNA
gattttcagcaatgggccta

SEQ ID NO: 2796 - RNA, 20 nt, synthetic construct
  source 1..20: mol_type = other RNA
gtggagcctgagtcatttta

SEQ ID NO: 2797 - RNA, 20 nt, synthetic construct
  source 1..20: mol_type = other RNA
aaggaattttggaccctaga

SEQ ID NO: 2798 - RNA, 20 nt, synthetic construct
  source 1..20: mol_type = other RNA
aatcttaaaaaaacgttttt

SEQ ID NO: 2799 - RNA, 20 nt, synthetic construct
  source 1..20: mol_type = other RNA
cctctctgagcctcattcct

SEQ ID NO: 2800 - RNA, 20 nt, synthetic construct
  source 1..20: mol_type = other RNA
aattattataactggtttac

SEQ ID NO: 2801 - RNA, 20 nt, synthetic construct
  source 1..20: mol_type = other RNA
agctcactgcaacctctgcc

SEQ ID NO: 2802 - RNA, 20 nt, synthetic construct
  source 1..20: mol_type = other RNA
agcgattctcctgcctcagc

SEQ ID NO: 2803 - RNA, 20 nt, synthetic construct
  source 1..20: mol_type = other RNA
cctgcctcagcctcccgagt

SEQ ID NO: 2804 - RNA, 20 nt, synthetic construct
  source 1..20: mol_type = other RNA
ccatgttggccaggctggtc

SEQ ID NO: 2805 - RNA, 20 nt, synthetic construct
  source 1..20: mol_type = other RNA
agaccagcctggccaacatg

SEQ ID NO: 2806 - RNA, 20 nt, synthetic construct
  source 1..20: mol_type = other RNA
aactcctgctagtgcctccc

SEQ ID NO: 2807 - RNA, 20 nt, synthetic construct
  source 1..20: mol_type = other RNA
agttgggctcagccaatggg

SEQ ID NO: 2808 - RNA, 20 nt, synthetic construct
  source 1..20: mol_type = other RNA
ccagccttctccagcctgct

SEQ ID NO: 2809 - RNA, 20 nt, synthetic construct
  source 1..20: mol_type = other RNA
ttttaggaaggattctgaac

SEQ ID NO: 2810 - RNA, 20 nt, synthetic construct
  source 1..20: mol_type = other RNA
cgctccttgatcaggctggg

SEQ ID NO: 2811 - RNA, 20 nt, synthetic construct
  source 1..20: mol_type = other RNA
aggcctgcagaagccagaga

SEQ ID NO: 2812 - RNA, 20 nt, synthetic construct
  source 1..20: mol_type = other RNA
acttctcggggggctttggg

SEQ ID NO: 2813 - RNA, 20 nt, synthetic construct
  source 1..20: mol_type = other RNA
cggggggctttgggactcag

SEQ ID NO: 2814 - RNA, 20 nt, synthetic construct
  source 1..20: mol_type = other RNA
gtcccatccccatcccctgc

SEQ ID NO: 2815 - RNA, 20 nt, synthetic construct
  source 1..20: mol_type = other RNA
ttcttttctcttgttttcct

SEQ ID NO: 2816 - RNA, 20 nt, synthetic construct
  source 1..20: mol_type = other RNA
tttctcttgttttccttttc

SEQ ID NO: 2817 - RNA, 20 nt, synthetic construct
  source 1..20: mol_type = other RNA
cttgttttccttttctcacc

SEQ ID NO: 2818 - RNA, 20 nt, synthetic construct
  source 1..20: mol_type = other RNA
ttttctcaccatttggaatg

SEQ ID NO: 2819 - RNA, 20 nt, synthetic construct
  source 1..20: mol_type = other RNA
tgttttgctgctccacctgc

SEQ ID NO: 2820 - RNA, 20 nt, synthetic construct
  source 1..20: mol_type = other RNA
actgttccctctgcctggtg

SEQ ID NO: 2821 - RNA, 20 nt, synthetic construct
  source 1..20: mol_type = other RNA
tgtctgtaaaatgggcacat

SEQ ID NO: 2822 - RNA, 20 nt, synthetic construct
  source 1..20: mol_type = other RNA
tagcactgctgtgacaaatt

SEQ ID NO: 2823 - RNA, 20 nt, synthetic construct
  source 1..20: mol_type = other RNA
ggcctccaggactgcagaga

SEQ ID NO: 2824 - RNA, 20 nt, synthetic construct
  source 1..20: mol_type = other RNA
ctgcagtcctggaggccaga

SEQ ID NO: 2825 - RNA, 20 nt, synthetic construct
  source 1..20: mol_type = other RNA
ggcttctggcctccaggact

SEQ ID NO: 2826 - RNA, 20 nt, synthetic construct
  source 1..20: mol_type = other RNA
ccctggagccccccgggaga

SEQ ID NO: 2827 - RNA, 20 nt, synthetic construct
  source 1..20: mol_type = other RNA
cccggggggctccagggaga

SEQ ID NO: 2828 - RNA, 20 nt, synthetic construct
  source 1..20: mol_type = other RNA
cacagccttctctgtgtctc

SEQ ID NO: 2829 - RNA, 20 nt, synthetic construct
  source 1..20: mol_type = other RNA
ccacatgagatcatcctgga

SEQ ID NO: 2830 - RNA, 20 nt, synthetic construct
  source 1..20: mol_type = other RNA
aaataaggtcacagccacag

SEQ ID NO: 2831 - RNA, 20 nt, synthetic construct
  source 1..20: mol_type = other RNA
ggttcctctgcaaaagggag

SEQ ID NO: 2832 - RNA, 20 nt, synthetic construct
  source 1..20: mol_type = other RNA
tctgcaaaagggaggtaatg

SEQ ID NO: 2833 - RNA, 20 nt, synthetic construct
  source 1..20: mol_type = other RNA
tttcttaccattcaataata

SEQ ID NO: 2834 - RNA, 20 nt, synthetic construct
  source 1..20: mol_type = other RNA
ataataacgttttgagcacc

SEQ ID NO: 2835 - RNA, 20 nt, synthetic construct
  source 1..20: mol_type = other RNA
catttgtatccccagcacct

SEQ ID NO: 2836 - RNA, 20 nt, synthetic construct
  source 1..20: mol_type = other RNA
tccaggaatcctttcctgat

SEQ ID NO: 2837 - RNA, 20 nt, synthetic construct
  source 1..20: mol_type = other RNA
tttcacatctgacctggagg

SEQ ID NO: 2838 - RNA, 20 nt, synthetic construct
  source 1..20: mol_type = other RNA
tgtgggggcttttaccaggc

SEQ ID NO: 2839 - RNA, 20 nt, synthetic construct
  source 1..20: mol_type = other RNA
ctggcttgtggccacatttc

SEQ ID NO: 2840 - RNA, 20 nt, synthetic construct
  source 1..20: mol_type = other RNA
ggtggctgctggtgttccct

SEQ ID NO: 2841 - RNA, 20 nt, synthetic construct
  source 1..20: mol_type = other RNA
ggcttctggtggctgctggt

SEQ ID NO: 2842 - RNA, 20 nt, synthetic construct
  source 1..20: mol_type = other RNA
acctgaggccctgcttttcc

SEQ ID NO: 2843 - RNA, 20 nt, synthetic construct
  source 1..20: mol_type = other RNA
agggccaggccatttccgct

SEQ ID NO: 2844 - RNA, 20 nt, synthetic construct
  source 1..20: mol_type = other RNA
ttccttgcttcctttcttcc

SEQ ID NO: 2845 - RNA, 20 nt, synthetic construct
  source 1..20: mol_type = other RNA
ttgcttcctttcttcctctc

SEQ ID NO: 2846 - RNA, 20 nt, synthetic construct
  source 1..20: mol_type = other RNA
tttcttcctctctcccttct

SEQ ID NO: 2847 - RNA, 20 nt, synthetic construct
  source 1..20: mol_type = other RNA
tcctctctcccttctccatc

SEQ ID NO: 2848 - RNA, 20 nt, synthetic construct
  source 1..20: mol_type = other RNA
tggagaatccaaactgatcc

SEQ ID NO: 2849 - RNA, 20 nt, synthetic construct
  source 1..20: mol_type = other RNA
aaaaatagtatcaaagtgta

SEQ ID NO: 2850 - RNA, 20 nt, synthetic construct
  source 1..20: mol_type = other RNA
tattattgttagatattgat

SEQ ID NO: 2851 - RNA, 20 nt, synthetic construct
  source 1..20: mol_type = other RNA
tatgaatatcaatatctaac

SEQ ID NO: 2852 - RNA, 20 nt, synthetic construct
  source 1..20: mol_type = other RNA
ttgtctatgaaatacattat

SEQ ID NO: 2853 - RNA, 20 nt, synthetic construct
  source 1..20: mol_type = other RNA
ataatgtatttcatagacaa

SEQ ID NO: 2854 - RNA, 20 nt, synthetic construct
  source 1..20: mol_type = other RNA
ctcgtttaacctccaaaaaa

SEQ ID NO: 2855 - RNA, 20 nt, synthetic construct
  source 1..20: mol_type = other RNA
acactgctccccttttaaaa

SEQ ID NO: 2856 - RNA, 20 nt, synthetic construct
  source 1..20: mol_type = other RNA
taggggggccgctgggtgga

SEQ ID NO: 2857 - RNA, 20 nt, synthetic construct
  source 1..20: mol_type = other RNA
ctcccttactgacttccttc

SEQ ID NO: 2858 - RNA, 20 nt, synthetic construct
  source 1..20: mol_type = other RNA
tacagagtacaggttttgat

SEQ ID NO: 2859 - RNA, 20 nt, synthetic construct
  source 1..20: mol_type = other RNA
gttttaaaggcaagaatcaa

SEQ ID NO: 2860 - RNA, 20 nt, synthetic construct
  source 1..20: mol_type = other RNA
ttgccactgccatttcctcc

SEQ ID NO: 2861 - RNA, 20 nt, synthetic construct
  source 1..20: mol_type = other RNA
agaccagcctgttcaacatg

SEQ ID NO: 2862 - RNA, 20 nt, synthetic construct
  source 1..20: mol_type = other RNA
ccatgttgaacaggctggtc

SEQ ID NO: 2863 - RNA, 20 nt, synthetic construct
  source 1..20: mol_type = other RNA
acatggtgaaaccccgtctc

SEQ ID NO: 2864 - RNA, 20 nt, synthetic construct
  source 1..20: mol_type = other RNA
cctgccttagcctcccaagt

SEQ ID NO: 2865 - RNA, 20 nt, synthetic construct
  source 1..20: mol_type = other RNA
agcgattctcctgccttagc

SEQ ID NO: 2866 - RNA, 20 nt, synthetic construct
  source 1..20: mol_type = other RNA
atctcaaaaataaataagta

SEQ ID NO: 2867 - RNA, 20 nt, synthetic construct
  source 1..20: mol_type = other RNA
ccgtgttagcaaggatggtc

SEQ ID NO: 2868 - RNA, 20 nt, synthetic construct
  source 1..20: mol_type = other RNA
cctgcctcagcctcctgagt

SEQ ID NO: 2869 - RNA, 20 nt, synthetic construct
  source 1..20: mol_type = other RNA
cgccattctcctgcctcagc

SEQ ID NO: 2870 - RNA, 20 nt, synthetic construct
  source 1..20: mol_type = other RNA
agacggagtctcgctctatt

SEQ ID NO: 2871 - RNA, 20 nt, synthetic construct
  source 1..20: mol_type = other RNA
ttccagacggagtctcgctc

SEQ ID NO: 2872 - RNA, 20 nt, synthetic construct
  source 1..20: mol_type = other RNA
agtttgtattggtcaaggtt

SEQ ID NO: 2873 - RNA, 20 nt, synthetic construct
  source 1..20: mol_type = other RNA
ctgcagaaccttgaccaata

SEQ ID NO: 2874 - RNA, 20 nt, synthetic construct
  source 1..20: mol_type = other RNA
gcttctctgcagaaccttga

SEQ ID NO: 2875 - RNA, 20 nt, synthetic construct
  source 1..20: mol_type = other RNA
gcagagaagcagaaccagta

SEQ ID NO: 2876 - RNA, 20 nt, synthetic construct
  source 1..20: mol_type = other RNA
cttaaggccttcaactgatt

SEQ ID NO: 2877 - RNA, 20 nt, synthetic construct
  source 1..20: mol_type = other RNA
actgattaaatgaggcctgc

SEQ ID NO: 2878 - RNA, 20 nt, synthetic construct
  source 1..20: mol_type = other RNA
gatttaaatgttagtcacat

SEQ ID NO: 2879 - RNA, 20 nt, synthetic construct
  source 1..20: mol_type = other RNA
actggcttttgaccaaacat

SEQ ID NO: 2880 - RNA, 20 nt, synthetic construct
  source 1..20: mol_type = other RNA
aagtgccacggggggaaact

SEQ ID NO: 2881 - RNA, 20 nt, synthetic construct
  source 1..20: mol_type = other RNA
gcctgggcagtcagattttc

SEQ ID NO: 2882 - RNA, 20 nt, synthetic construct
  source 1..20: mol_type = other RNA
ccattcacccctgcaccagg

SEQ ID NO: 2883 - RNA, 20 nt, synthetic construct
  source 1..20: mol_type = other RNA
taacgtgtttttatagagac

SEQ ID NO: 2884 - RNA, 20 nt, synthetic construct
  source 1..20: mol_type = other RNA
tgtgtgtgtgtgtgtgtgtg

SEQ ID NO: 2885 - RNA, 20 nt, synthetic construct
  source 1..20: mol_type = other RNA
acttttttgctggtttgaga

SEQ ID NO: 2886 - RNA, 20 nt, synthetic construct
  source 1..20: mol_type = other RNA
ctctatctccattttgaaac

SEQ ID NO: 2887 - RNA, 20 nt, synthetic construct
  source 1..20: mol_type = other RNA
gtgttttcaaagcccattct

SEQ ID NO: 2888 - RNA, 20 nt, synthetic construct
  source 1..20: mol_type = other RNA
ctcttatggaggaggaagct

SEQ ID NO: 2889 - RNA, 20 nt, synthetic construct
  source 1..20: mol_type = other RNA
caccctcactctcctgttcc

SEQ ID NO: 2890 - RNA, 20 nt, synthetic construct
  source 1..20: mol_type = other RNA
acctctctgagccttagttt

SEQ ID NO: 2891 - RNA, 20 nt, synthetic construct
  source 1..20: mol_type = other RNA
caactctgcagctgaccagc

SEQ ID NO: 2892 - RNA, 20 nt, synthetic construct
  source 1..20: mol_type = other RNA
gagatggggtcttgctgtgt

SEQ ID NO: 2893 - RNA, 20 nt, synthetic construct
  source 1..20: mol_type = other RNA
tgggctcaagcaatcctctg

SEQ ID NO: 2894 - RNA, 20 nt, synthetic construct
  source 1..20: mol_type = other RNA
tggcactggggagggataca

SEQ ID NO: 2895 - RNA, 20 nt, synthetic construct
  source 1..20: mol_type = other RNA
ccatcgcatcttttcagtac

SEQ ID NO: 2896 - RNA, 20 nt, synthetic construct
  source 1..20: mol_type = other RNA
ttgctatagttttctccatc

SEQ ID NO: 2897 - RNA, 20 nt, synthetic construct
  source 1..20: mol_type = other RNA
cttccttgctatagttttct

SEQ ID NO: 2898 - RNA, 20 nt, synthetic construct
  source 1..20: mol_type = other RNA
cactcaccccccaacgatgt

SEQ ID NO: 2899 - RNA, 20 nt, synthetic construct
  source 1..20: mol_type = other RNA
cacccctacttcacagagga

SEQ ID NO: 2900 - RNA, 20 nt, synthetic construct
  source 1..20: mol_type = other RNA
aggtttcttcctctgtgaag

SEQ ID NO: 2901 - RNA, 20 nt, synthetic construct
  source 1..20: mol_type = other RNA
agacctgttttgcttttgta

SEQ ID NO: 2902 - RNA, 20 nt, synthetic construct
  source 1..20: mol_type = other RNA
gggttttgtagcatttttat

SEQ ID NO: 2903 - RNA, 20 nt, synthetic construct
  source 1..20: mol_type = other RNA
tttcattcctaggataggca

SEQ ID NO: 2904 - RNA, 20 nt, synthetic construct
  source 1..20: mol_type = other RNA
ttcttttctccccagtacct

SEQ ID NO: 2905 - RNA, 20 nt, synthetic construct
  source 1..20: mol_type = other RNA
gaattttaaatcatgaaaaa

SEQ ID NO: 2906 - RNA, 20 nt, synthetic construct
  source 1..20: mol_type = other RNA
tcccagattacattttctga

SEQ ID NO: 2907 - RNA, 20 nt, synthetic construct
  source 1..20: mol_type = other RNA
tgcaagccacaccccttcct

SEQ ID NO: 2908 - RNA, 20 nt, synthetic construct
  source 1..20: mol_type = other RNA
tctccaccaaagcttttggc

SEQ ID NO: 2909 - RNA, 20 nt, synthetic construct
  source 1..20: mol_type = other RNA
aagagtataaaataaatttt

SEQ ID NO: 2910 - RNA, 20 nt, synthetic construct
  source 1..20: mol_type = other RNA
ttttgaaattttataaacaa

SEQ ID NO: 2911 - RNA, 20 nt, synthetic construct
  source 1..20: mol_type = other RNA
cctggagtcctcacacggtc

SEQ ID NO: 2912 - RNA, 20 nt, synthetic construct
  source 1..20: mol_type = other RNA
tccaaaaaattggcagtaaa

SEQ ID NO: 2913 - RNA, 20 nt, synthetic construct
  source 1..20: mol_type = other RNA
ctcctgattttgggctcctg

SEQ ID NO: 2914 - RNA, 20 nt, synthetic construct
  source 1..20: mol_type = other RNA
accattggttttgagtacgt

SEQ ID NO: 2915 - RNA, 20 nt, synthetic construct
  source 1..20: mol_type = other RNA
gccctgttttgcctttagtt

SEQ ID NO: 2916 - RNA, 20 nt, synthetic construct
  source 1..20: mol_type = other RNA
aaatacaaaatgtacaaaat

SEQ ID NO: 2917 - RNA, 20 nt, synthetic construct
  source 1..20: mol_type = other RNA
tatatattttgtacattttg

SEQ ID NO: 2918 - RNA, 20 nt, synthetic construct
  source 1..20: mol_type = other RNA
ctcatttataccagctccct

SEQ ID NO: 2919 - RNA, 20 nt, synthetic construct
  source 1..20: mol_type = other RNA
attgctttatatttatttct

SEQ ID NO: 2920 - RNA, 20 nt, synthetic construct
  source 1..20: mol_type = other RNA
cagaaataaatataaagcaa

SEQ ID NO: 2921 - RNA, 20 nt, synthetic construct
  source 1..20: mol_type = other RNA
gtaattatgttttaagcaaa

SEQ ID NO: 2922 - RNA, 20 nt, synthetic construct
  source 1..20: mol_type = other RNA
cagaattatctttttaatgc

SEQ ID NO: 2923 - RNA, 20 nt, synthetic construct
  source 1..20: mol_type = other RNA
ccaaacagattttaaaaaca

SEQ ID NO: 2924 - RNA, 20 nt, synthetic construct
  source 1..20: mol_type = other RNA
ttaagtaattgatgtcaaat

SEQ ID NO: 2925 - RNA, 20 nt, synthetic construct
  source 1..20: mol_type = other RNA
ggagaacacagcattttcaa

SEQ ID NO: 2926 - RNA, 20 nt, synthetic construct
  source 1..20: mol_type = other RNA
aaattgctcttttcaatcta

SEQ ID NO: 2927 - RNA, 20 nt, synthetic construct
  source 1..20: mol_type = other RNA
gatataattagattgaaaag

SEQ ID NO: 2928 - RNA, 20 nt, synthetic construct
  source 1..20: mol_type = other RNA
atctaattatatcagaaaaa

SEQ ID NO: 2929 - RNA, 20 nt, synthetic construct
  source 1..20: mol_type = other RNA
caatttttgatcctgatcct

SEQ ID NO: 2930 - RNA, 20 nt, synthetic construct
  source 1..20: mol_type = other RNA
ttgtaaaatagtaattaagt

SEQ ID NO: 2931 - RNA, 20 nt, synthetic construct
  source 1..20: mol_type = other RNA
ttttcattgtaaaatagtaa

SEQ ID NO: 2932 - RNA, 20 nt, synthetic construct
  source 1..20: mol_type = other RNA
tttggtttttatattttaag

SEQ ID NO: 2933 - RNA, 20 nt, synthetic construct
  source 1..20: mol_type = other RNA
taaaatataaaaaccaaagg

SEQ ID NO: 2934 - RNA, 20 nt, synthetic construct
  source 1..20: mol_type = other RNA
tgtaacaaaaaagtctgcca

SEQ ID NO: 2935 - RNA, 20 nt, synthetic construct
  source 1..20: mol_type = other RNA
gtggagattttcggaaatag

SEQ ID NO: 2936 - RNA, 20 nt, synthetic construct
  source 1..20: mol_type = other RNA
catttctgtggagattttcg

SEQ ID NO: 2937 - RNA, 20 nt, synthetic construct
  source 1..20: mol_type = other RNA
caaggaaagcatttttaagc

SEQ ID NO: 2938 - RNA, 20 nt, synthetic construct
  source 1..20: mol_type = other RNA
ttttcttttctgcagggttc

SEQ ID NO: 2939 - RNA, 20 nt, synthetic construct
  source 1..20: mol_type = other RNA
acctcagggcccccctactc

SEQ ID NO: 2940 - RNA, 20 nt, synthetic construct
  source 1..20: mol_type = other RNA
ttccacctcagggcccccct

SEQ ID NO: 2941 - RNA, 20 nt, synthetic construct
  source 1..20: mol_type = other RNA
gaattttatttatcaaatgt

SEQ ID NO: 2942 - RNA, 20 nt, synthetic construct
  source 1..20: mol_type = other RNA
ccttgcctcagcctcccaag

SEQ ID NO: 2943 - RNA, 20 nt, synthetic construct
  source 1..20: mol_type = other RNA
agcgattctccttgcctcag

SEQ ID NO: 2944 - RNA, 20 nt, synthetic construct
  source 1..20: mol_type = other RNA
cccaggttccagcgattctc

SEQ ID NO: 2945 - protein, 14 aa, synthetic construct
DVAVYFSPEEWGCL

SEQ ID NO: 2946 - protein, 15 aa, synthetic construct
  VARIANT 1: note = D or E
  VARIANT 6: note = N or T
  VARIANT 8: note = A, E, G, Q, R, or S
  VARIANT 9: note = H or N
  VARIANT 10: note = L, M, or V
  VARIANT 11: note = A, L, or V
  VARIANT 13: note = L or V
  VARIANT 14: note = A, G, or V
  VARIANT 15: note = C, F, or L
XVMLEXYXXXXSXXX

SEQ ID NO: 2947 - RNA, 109 nt, synthetic construct
  source 1..109: mol_type = other RNA
actggcgcttttatctgattactttgagagccatcaccagcgactatgtcgtagtgggtaaagctccctcttcggagggagcatcaaagnnnnnnnnnnnnnnnnnnnn

SEQ ID NO: 2948 - RNA, 109 nt, synthetic construct; identical to SEQ ID NO: 2947
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 107..109: mod_base = OTHER; note = linked via phosphorothioate
  modified_base 107: mod_base = OTHER; note = any 2'-O-methyl ribonucelotide
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2949 - RNA, 112 nt, synthetic construct
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 109..112: mod_base = OTHER; note = linked via phosphorothioate
  modified_base 110: mod_base = um
  modified_base 111: mod_base = um
  modified_base 112: mod_base = um
  source 1..112: mol_type = other RNA
actggcgcttttatctgattactttgagagccatcaccagcgactatgtcgtagtgggtaaagctccctcttcggagggagcatcaaagnnnnnnnnnnnnnnnnnnnnttt

SEQ ID NO: 2950 - RNA, 109 nt, synthetic construct; identical to SEQ ID NO: 2947
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = gm
  modified_base 6: mod_base = cm
  modified_base 7: mod_base = gm
  modified_base 8: mod_base = cm
  modified_base 9: mod_base = um
  modified_base 10: mod_base = um
  modified_base 11: mod_base = um
  modified_base 12: mod_base = um
  modified_base 13: mod_base = OTHER; note = 2'-O-methyladenosine
  modified_base 14: mod_base = um
  modified_base 15: mod_base = cm
  modified_base 16: mod_base = um
  modified_base 17: mod_base = gm
  modified_base 18: mod_base = OTHER; note = 2'-O-methyladenosine
  modified_base 19: mod_base = um
  modified_base 27: mod_base = OTHER; note = 2'-O-methyladenosine
  modified_base 28: mod_base = gm
  modified_base 29: mod_base = OTHER; note = 2'-O-methyladenosine
  modified_base 30: mod_base = gm
  modified_base 31: mod_base = cm
  modified_base 32: mod_base = cm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 38: mod_base = cm
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 57: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 83: mod_base = OTHER; note = 2'-O-methyladenosine
  modified_base 84: mod_base = um
  modified_base 85: mod_base = cm
  modified_base 86: mod_base = OTHER; note = 2'-O-methyladenosine
  modified_base 107: mod_base = OTHER; note = any 2'-O-methyl ribonucelotide
  modified_base 107..109: mod_base = OTHER; note = linked via phosphorothioate
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2951 - RNA, 109 nt, synthetic construct; identical to SEQ ID NO: 2947
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = gm
  modified_base 6: mod_base = cm
  modified_base 7: mod_base = gm
  modified_base 8: mod_base = cm
  modified_base 13: mod_base = OTHER; note = 2'-O-methyladenosine
  modified_base 14: mod_base = um
  modified_base 15: mod_base = cm
  modified_base 16: mod_base = um
  modified_base 17: mod_base = gm
  modified_base 18: mod_base = OTHER; note = 2'-O-methyladenosine
  modified_base 19: mod_base = um
  modified_base 27: mod_base = OTHER; note = 2'-O-methyladenosine
  modified_base 28: mod_base = gm
  modified_base 29: mod_base = OTHER; note = 2'-O-methyladenosine
  modified_base 30: mod_base = gm
  modified_base 31: mod_base = cm
  modified_base 32: mod_base = cm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 38: mod_base = cm
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 57: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 83: mod_base = OTHER; note = 2'-O-methyladenosine
  modified_base 84: mod_base = um
  modified_base 107: mod_base = OTHER; note = any 2'-O-methyl ribonucelotide
  modified_base 107..109: mod_base = OTHER; note = linked via phosphorothioate
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2952 - RNA, 109 nt, synthetic construct; identical to SEQ ID NO: 2947
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 107: mod_base = OTHER; note = any 2'-O-methyl ribonucelotide
  modified_base 107..109: mod_base = OTHER; note = linked via phosphorothioate
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2953 - RNA, 109 nt, synthetic construct; identical to SEQ ID NO: 2947
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 107: mod_base = OTHER; note = any 2'-O-methyl ribonucelotide
  modified_base 107..109: mod_base = OTHER; note = linked via phosphorothioate
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2954 - RNA, 109 nt, synthetic construct; identical to SEQ ID NO: 2947
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 6: mod_base = cm
  modified_base 8: mod_base = cm
  modified_base 9: mod_base = um
  modified_base 14: mod_base = um
  modified_base 15: mod_base = cm
  modified_base 27: mod_base = OTHER; note = 2'-O-methyladenosine
  modified_base 28: mod_base = gm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 42: mod_base = gm
  modified_base 43: mod_base = OTHER; note = 2'-O-methyladenosine
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 58: mod_base = gm
  modified_base 59: mod_base = um
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 83: mod_base = OTHER; note = 2'-O-methyladenosine
  modified_base 84: mod_base = um
  modified_base 106..109: mod_base = OTHER; note = linked via phosphorothioate
  modified_base 107: mod_base = OTHER; note = any 2'-O-methyl ribonucelotide
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2955 - RNA, 109 nt, synthetic construct; identical to SEQ ID NO: 2947
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 42: mod_base = gm
  modified_base 43: mod_base = OTHER; note = 2'-O-methyladenosine
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 83: mod_base = OTHER; note = 2'-O-methyladenosine
  modified_base 84: mod_base = um
  modified_base 106..109: mod_base = OTHER; note = linked via phosphorothioate
  modified_base 107: mod_base = OTHER; note = any 2'-O-methyl ribonucelotide
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2956 - RNA, 109 nt, synthetic construct; identical to SEQ ID NO: 2947
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 6: mod_base = cm
  modified_base 7: mod_base = gm
  modified_base 9: mod_base = um
  modified_base 14: mod_base = um
  modified_base 15: mod_base = cm
  modified_base 27: mod_base = OTHER; note = 2'-O-methyladenosine
  modified_base 28: mod_base = gm
  modified_base 42: mod_base = gm
  modified_base 43: mod_base = OTHER; note = 2'-O-methyladenosine
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 106..109: mod_base = OTHER; note = linked via phosphorothioate
  modified_base 107: mod_base = OTHER; note = any 2'-O-methyl ribonucelotide
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2957 - RNA, 119 nt, synthetic construct
  source 1..119: mol_type = other RNA
actggcgcttctatctgattactctgagcgccatcaccagcgactatgtcgtagtgggtaaagccgcttacggacttcggtccgtaagaggcatcagagnnnnnnnnnnnnnnnnnnnn

SEQ ID NO: 2958 - RNA, 119 nt, synthetic construct; identical to SEQ ID NO: 2957
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 117: mod_base = OTHER; note = any 2'-O-methyl ribonucelotide
  modified_base 117..119: mod_base = OTHER; note = linked via phosphorothioate
  modified_base 118: mod_base = OTHER; note = any 2'-O-methyl ribonucelotide
  modified_base 119: mod_base = OTHER; note = any 2'-O-methyl ribonucelotide
  source 1..119: mol_type = other RNA

SEQ ID NO: 2959 - RNA, 122 nt, synthetic construct
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 119..122: mod_base = OTHER; note = linked via phosphorothioate
  modified_base 120: mod_base = um
  modified_base 121: mod_base = um
  modified_base 122: mod_base = um
  source 1..122: mol_type = other RNA
actggcgcttctatctgattactctgagcgccatcaccagcgactatgtcgtagtgggtaaagccgcttacggacttcggtccgtaagaggcatcagagnnnnnnnnnnnnnnnnnnnnttt

SEQ ID NO: 2960 - RNA, 119 nt, synthetic construct; identical to SEQ ID NO: 2957
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = gm
  modified_base 6: mod_base = cm
  modified_base 7: mod_base = gm
  modified_base 8: mod_base = cm
  modified_base 9: mod_base = um
  modified_base 10: mod_base = um
  modified_base 11: mod_base = cm
  modified_base 12: mod_base = um
  modified_base 13: mod_base = OTHER; note = 2'-O-methyladenosine
  modified_base 14: mod_base = um
  modified_base 15: mod_base = cm
  modified_base 16: mod_base = um
  modified_base 17: mod_base = gm
  modified_base 18: mod_base = OTHER; note = 2'-O-methyladenosine
  modified_base 19: mod_base = um
  modified_base 27: mod_base = OTHER; note = 2'-O-methyladenosine
  modified_base 28: mod_base = gm
  modified_base 29: mod_base = cm
  modified_base 30: mod_base = gm
  modified_base 31: mod_base = cm
  modified_base 32: mod_base = cm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 38: mod_base = cm
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 57: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 93: mod_base = OTHER; note = 2'-O-methyladenosine
  modified_base 94: mod_base = um
  modified_base 95: mod_base = cm
  modified_base 96: mod_base = OTHER; note = 2'-O-methyladenosine
  modified_base 117: mod_base = OTHER; note = any 2'-O-methyl ribonucelotide
  modified_base 117..119: mod_base = OTHER; note = linked via phosphorothioate
  modified_base 118: mod_base = OTHER; note = any 2'-O-methyl ribonucelotide
  modified_base 119: mod_base = OTHER; note = any 2'-O-methyl ribonucelotide
  source 1..119: mol_type = other RNA

SEQ ID NO: 2961 - RNA, 119 nt, synthetic construct; identical to SEQ ID NO: 2957
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = gm
  modified_base 6: mod_base = cm
  modified_base 7: mod_base = gm
  modified_base 8: mod_base = cm
  modified_base 13: mod_base = OTHER; note = 2'-O-methyladenosine
  modified_base 14: mod_base = um
  modified_base 15: mod_base = cm
  modified_base 16: mod_base = um
  modified_base 17: mod_base = gm
  modified_base 18: mod_base = OTHER; note = 2'-O-methyladenosine
  modified_base 19: mod_base = um
  modified_base 27: mod_base = OTHER; note = 2'-O-methyladenosine
  modified_base 28: mod_base = gm
  modified_base 29: mod_base = cm
  modified_base 30: mod_base = gm
  modified_base 31: mod_base = cm
  modified_base 32: mod_base = cm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 38: mod_base = cm
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 57: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 93: mod_base = OTHER; note = 2'-O-methyladenosine
  modified_base 94: mod_base = um
  modified_base 117: mod_base = OTHER; note = any 2'-O-methyl ribonucelotide
  modified_base 117..119: mod_base = OTHER; note = linked via phosphorothioate
  modified_base 118: mod_base = OTHER; note = any 2'-O-methyl ribonucelotide
  modified_base 119: mod_base = OTHER; note = any 2'-O-methyl ribonucelotide
  source 1..119: mol_type = other RNA

SEQ ID NO: 2962 - RNA, 119 nt, synthetic construct; identical to SEQ ID NO: 2957
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 117: mod_base = OTHER; note = any 2'-O-methyl ribonucelotide
  modified_base 117..119: mod_base = OTHER; note = linked via phosphorothioate
  modified_base 118: mod_base = OTHER; note = any 2'-O-methyl ribonucelotide
  modified_base 119: mod_base = OTHER; note = any 2'-O-methyl ribonucelotide
  source 1..119: mol_type = other RNA

SEQ ID NO: 2963 - RNA, 119 nt, synthetic construct; identical to SEQ ID NO: 2957
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 117: mod_base = OTHER; note = any 2'-O-methyl ribonucelotide
  modified_base 117..119: mod_base = OTHER; note = linked via phosphorothioate
  modified_base 118: mod_base = OTHER; note = any 2'-O-methyl ribonucelotide
  modified_base 119: mod_base = OTHER; note = any 2'-O-methyl ribonucelotide
  source 1..119: mol_type = other RNA

SEQ ID NO: 2964 - RNA, 119 nt, synthetic construct; identical to SEQ ID NO: 2957
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 6: mod_base = cm
  modified_base 8: mod_base = cm
  modified_base 9: mod_base = um
  modified_base 14: mod_base = um
  modified_base 15: mod_base = cm
  modified_base 27: mod_base = OTHER; note = 2'-O-methyladenosine
  modified_base 28: mod_base = gm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 42: mod_base = gm
  modified_base 43: mod_base = OTHER; note = 2'-O-methyladenosine
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 93: mod_base = OTHER; note = 2'-O-methyladenosine
  modified_base 94: mod_base = um
  modified_base 116..119: mod_base = OTHER; note = linked via phosphorothioate
  modified_base 117: mod_base = OTHER; note = any 2'-O-methyl ribonucelotide
  modified_base 118: mod_base = OTHER; note = any 2'-O-methyl ribonucelotide
  modified_base 119: mod_base = OTHER; note = any 2'-O-methyl ribonucelotide
  source 1..119: mol_type = other RNA

SEQ ID NO: 2965 - RNA, 119 nt, synthetic construct; identical to SEQ ID NO: 2957
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 42: mod_base = gm
  modified_base 43: mod_base = OTHER; note = 2'-O-methyladenosine
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 93: mod_base = OTHER; note = 2'-O-methyladenosine
  modified_base 94: mod_base = um
  modified_base 116..119: mod_base = OTHER; note = linked via phosphorothioate
  modified_base 117: mod_base = OTHER; note = any 2'-O-methyl ribonucelotide
  modified_base 118: mod_base = OTHER; note = any 2'-O-methyl ribonucelotide
  modified_base 119: mod_base = OTHER; note = any 2'-O-methyl ribonucelotide
  source 1..119: mol_type = other RNA

SEQ ID NO: 2966 - RNA, 119 nt, synthetic construct; identical to SEQ ID NO: 2957
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 6: mod_base = cm
  modified_base 8: mod_base = cm
  modified_base 9: mod_base = um
  modified_base 14: mod_base = um
  modified_base 15: mod_base = cm
  modified_base 27: mod_base = OTHER; note = 2'-O-methyladenosine
  modified_base 28: mod_base = gm
  modified_base 42: mod_base = gm
  modified_base 43: mod_base = OTHER; note = 2'-O-methyladenosine
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 116..119: mod_base = OTHER; note = linked via phosphorothioate
  modified_base 117: mod_base = OTHER; note = any 2'-O-methyl ribonucelotide
  modified_base 118: mod_base = OTHER; note = any 2'-O-methyl ribonucelotide
  modified_base 119: mod_base = OTHER; note = any 2'-O-methyl ribonucelotide
  source 1..119: mol_type = other RNA

SEQ ID NO: 2967 - RNA, 109 nt, synthetic construct
  source 1..109: mol_type = other RNA
actggcgcttctatctgattactctgagcgccatcaccagcgactatgtcgtagtgggtaaagctccctcttcggagggagcatcagagnnnnnnnnnnnnnnnnnnnn

SEQ ID NO: 2968 - RNA, 109 nt, synthetic construct; identical to SEQ ID NO: 2967
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 106..109: mod_base = OTHER; note = linked via phosphorothioate
  modified_base 107: mod_base = OTHER; note = any 2'-O-methyl ribonucelotide
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2969 - RNA, 112 nt, synthetic construct
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 109..112: mod_base = OTHER; note = linked via phosphorothioate
  modified_base 110: mod_base = um
  modified_base 111: mod_base = um
  modified_base 112: mod_base = um
  source 1..112: mol_type = other RNA
actggcgcttctatctgattactctgagcgccatcaccagcgactatgtcgtagtgggtaaagctccctcttcggagggagcatcagagnnnnnnnnnnnnnnnnnnnnttt

SEQ ID NO: 2970 - RNA, 109 nt, synthetic construct; identical to SEQ ID NO: 2967
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = gm
  modified_base 6: mod_base = cm
  modified_base 7: mod_base = gm
  modified_base 8: mod_base = cm
  modified_base 9: mod_base = um
  modified_base 10: mod_base = um
  modified_base 11: mod_base = cm
  modified_base 12: mod_base = um
  modified_base 13: mod_base = OTHER; note = 2'-O-methyladenosine
  modified_base 14: mod_base = um
  modified_base 15: mod_base = cm
  modified_base 16: mod_base = um
  modified_base 17: mod_base = gm
  modified_base 18: mod_base = OTHER; note = 2'-O-methyladenosine
  modified_base 19: mod_base = um
  modified_base 27: mod_base = OTHER; note = 2'-O-methyladenosine
  modified_base 28: mod_base = gm
  modified_base 29: mod_base = cm
  modified_base 30: mod_base = gm
  modified_base 31: mod_base = cm
  modified_base 32: mod_base = cm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 38: mod_base = cm
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 57: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 83: mod_base = OTHER; note = 2'-O-methyladenosine
  modified_base 84: mod_base = um
  modified_base 85: mod_base = cm
  modified_base 86: mod_base = OTHER; note = 2'-O-methyladenosine
  modified_base 106..109: mod_base = OTHER; note = linked via phosphorothioate
  modified_base 107: mod_base = OTHER; note = any 2'-O-methyl ribonucelotide
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2971 - RNA, 109 nt, synthetic construct; identical to SEQ ID NO: 2967
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = gm
  modified_base 6: mod_base = cm
  modified_base 7: mod_base = gm
  modified_base 8: mod_base = cm
  modified_base 13: mod_base = OTHER; note = 2'-O-methyladenosine
  modified_base 14: mod_base = um
  modified_base 15: mod_base = cm
  modified_base 16: mod_base = um
  modified_base 17: mod_base = gm
  modified_base 18: mod_base = OTHER; note = 2'-O-methyladenosine
  modified_base 19: mod_base = um
  modified_base 27: mod_base = OTHER; note = 2'-O-methyladenosine
  modified_base 28: mod_base = gm
  modified_base 29: mod_base = cm
  modified_base 30: mod_base = gm
  modified_base 31: mod_base = cm
  modified_base 32: mod_base = cm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 38: mod_base = cm
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 57: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 83: mod_base = OTHER; note = 2'-O-methyladenosine
  modified_base 84: mod_base = um
  modified_base 106..109: mod_base = OTHER; note = linked via phosphorothioate
  modified_base 107: mod_base = OTHER; note = any 2'-O-methyl ribonucelotide
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2972 - RNA, 109 nt, synthetic construct; identical to SEQ ID NO: 2967
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 106..109: mod_base = OTHER; note = linked via phosphorothioate
  modified_base 107: mod_base = OTHER; note = any 2'-O-methyl ribonucelotide
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2973 - RNA, 109 nt, synthetic construct; identical to SEQ ID NO: 2967
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 106..109: mod_base = OTHER; note = linked via phosphorothioate
  modified_base 107: mod_base = OTHER; note = any 2'-O-methyl ribonucelotide
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2974 - RNA, 109 nt, synthetic construct; identical to SEQ ID NO: 2967
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 6: mod_base = cm
  modified_base 8: mod_base = cm
  modified_base 9: mod_base = um
  modified_base 14: mod_base = um
  modified_base 15: mod_base = cm
  modified_base 27: mod_base = OTHER; note = 2'-O-methyladenosine
  modified_base 28: mod_base = gm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 42: mod_base = gm
  modified_base 43: mod_base = OTHER; note = 2'-O-methyladenosine
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 83: mod_base = OTHER; note = 2'-O-methyladenosine
  modified_base 84: mod_base = um
  modified_base 106..109: mod_base = OTHER; note = linked via phosphorothioate
  modified_base 107: mod_base = OTHER; note = any 2'-O-methyl ribonucelotide
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2975 - RNA, 109 nt, synthetic construct; identical to SEQ ID NO: 2967
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 42: mod_base = gm
  modified_base 43: mod_base = OTHER; note = 2'-O-methyladenosine
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 83: mod_base = OTHER; note = 2'-O-methyladenosine
  modified_base 84: mod_base = um
  modified_base 106..109: mod_base = OTHER; note = linked via phosphorothioate
  modified_base 107: mod_base = OTHER; note = any 2'-O-methyl ribonucelotide
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2976 - RNA, 109 nt, synthetic construct; identical to SEQ ID NO: 2967
  modified_base 1..4: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 6: mod_base = cm
  modified_base 8: mod_base = cm
  modified_base 9: mod_base = um
  modified_base 14: mod_base = um
  modified_base 15: mod_base = cm
  modified_base 27: mod_base = OTHER; note = 2'-O-methyladenosine
  modified_base 28: mod_base = gm
  modified_base 42: mod_base = gm
  modified_base 43: mod_base = OTHER; note = 2'-O-methyladenosine
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 106..109: mod_base = OTHER; note = linked via phosphorothioate
  modified_base 107: mod_base = OTHER; note = any 2'-O-methyl ribonucelotide
  modified_base 108: mod_base = OTHER; note = any 2'-O-methyl ribonucelotide
  modified_base 109: mod_base = OTHER; note = any 2'-O-methyl ribonucelotide
  source 1..109: mol_type = other RNA

SEQ ID NO: 2977 - DNA, 20 bp, synthetic construct
  source 1..20: mol_type = other DNA
gaggaggacggcctggccga

SEQ ID NO: 2978 - DNA, 20 bp, synthetic construct
  source 1..20: mol_type = other DNA
gccaggccgtcctcctcgga

SEQ ID NO: 2979 - DNA, 20 bp, synthetic construct
  source 1..20: mol_type = other DNA
gtgctcgggtgcttcggcca

SEQ ID NO: 2980 - DNA, 20 bp, synthetic construct
  source 1..20: mol_type = other DNA
cttggcagttgagcacgcgc

SEQ ID NO: 2981 - DNA, 20 bp, synthetic construct
  source 1..20: mol_type = other DNA
actttgtttgcaaagacctc

SEQ ID NO: 2982 - DNA, 20 bp, synthetic construct
  source 1..20: mol_type = other DNA
gagtgaaatggcctgctctg

SEQ ID NO: 2983 - DNA, 20 bp, synthetic construct
  source 1..20: mol_type = other DNA
gagcaggccatttcactcgg

SEQ ID NO: 2984 - DNA, 20 bp, synthetic construct
  source 1..20: mol_type = other DNA
ctcggaatctgctgtgcatc

SEQ ID NO: 2985 - DNA, 20 bp, synthetic construct
  source 1..20: mol_type = other DNA
ggaagggctgtcgatactgg

SEQ ID NO: 2986 - DNA, 20 bp, synthetic construct
  source 1..20: mol_type = other DNA
cctttgtttcttcccagtat

SEQ ID NO: 2987 - DNA, 20 bp, synthetic construct
  source 1..20: mol_type = other DNA
tcccagtatcgacagccctt

SEQ ID NO: 2988 - DNA, 20 bp, synthetic construct
  source 1..20: mol_type = other DNA
cagtatcgacagcccttcca

SEQ ID NO: 2989 - DNA, 20 bp, synthetic construct
  source 1..20: mol_type = other DNA
agaaagagcaagcctcatgt

SEQ ID NO: 2990 - DNA, 20 bp, synthetic construct
  source 1..20: mol_type = other DNA
ccttttcatcctcctgcctg

SEQ ID NO: 2991 - DNA, 20 bp, synthetic construct
  source 1..20: mol_type = other DNA
tcctcctgcctggtacacaa

SEQ ID NO: 2992 - DNA, 20 bp, synthetic construct
  source 1..20: mol_type = other DNA
agaaatcaactggacaagca

SEQ ID NO: 2993 - DNA, 20 bp, synthetic construct
  source 1..20: mol_type = other DNA
ttttacacaccatgttcaag

SEQ ID NO: 2994 - DNA, 20 bp, synthetic construct
  source 1..20: mol_type = other DNA
atttgcaaagattcctttta

SEQ ID NO: 2995 - DNA, 20 bp, synthetic construct
  source 1..20: mol_type = other DNA
tgaacatggtgtgtaaaagg

SEQ ID NO: 2996 - DNA, 20 bp, synthetic construct
  source 1..20: mol_type = other DNA
agaagattcaatttgcaaag

SEQ ID NO: 2997 - DNA, 20 bp, synthetic construct
  source 1..20: mol_type = other DNA
atggtaggcacaagctcagc

SEQ ID NO: 2998 - DNA, 20 bp, synthetic construct
  source 1..20: mol_type = other DNA
gaattctatggtaggcacaa

SEQ ID NO: 2999 - DNA, 20 bp, synthetic construct
  source 1..20: mol_type = other DNA
ggaaagctgagcttgtgcct

SEQ ID NO: 3000 - DNA, 20 bp, synthetic construct
  source 1..20: mol_type = other DNA
ggttttaagtttgcaaagac

SEQ ID NO: 3001 - DNA, 20 bp, synthetic construct
  source 1..20: mol_type = other DNA
gaatgtacctatatgacgtc

SEQ ID NO: 3002 - DNA, 20 bp, synthetic construct
  source 1..20: mol_type = other DNA
agggatttatactacaaaga

SEQ ID NO: 3003 - DNA, 20 bp, synthetic construct
  source 1..20: mol_type = other DNA
aggagcagctagttggtaag

SEQ ID NO: 3004 - DNA, 20 bp, synthetic construct
  source 1..20: mol_type = other DNA
aaacttagcctggaccccct

SEQ ID NO: 3005 - DNA, 20 bp, synthetic construct
  source 1..20: mol_type = other DNA
actggccttaacctggcagc

SEQ ID NO: 3006 - DNA, 20 bp, synthetic construct
  source 1..20: mol_type = other DNA
ttccactggccttaacctgg

SEQ ID NO: 3007 - DNA, 20 bp, synthetic construct
  source 1..20: mol_type = other DNA
gaatcaatcctactgtggac

SEQ ID NO: 3008 - DNA, 20 bp, synthetic construct
  source 1..20: mol_type = other DNA
gtgggcagcgaggagtccac

SEQ ID NO: 3009 - DNA, 20 bp, synthetic construct
  source 1..20: mol_type = other DNA
tgggtccaccttgtctcctg

SEQ ID NO: 3010 - DNA, 20 bp, synthetic construct
  source 1..20: mol_type = other DNA
gaagtctcactggtcagcag

SEQ ID NO: 3011 - DNA, 20 bp, synthetic construct
  source 1..20: mol_type = other DNA
gtgtttcctgggtccacctt

SEQ ID NO: 3012 - DNA, 20 bp, synthetic construct
  source 1..20: mol_type = other DNA
gccgggcccaccttttcagt

SEQ ID NO: 3013 - DNA, 20 bp, synthetic construct
  source 1..20: mol_type = other DNA
agcccagttaggatttggga

SEQ ID NO: 3014 - DNA, 20 bp, synthetic construct
  source 1..20: mol_type = other DNA
tccctctgcgcgtaatctga

SEQ ID NO: 3015 - DNA, 20 bp, synthetic construct
  source 1..20: mol_type = other DNA
ctctgcgcgtaatctgacgc

SEQ ID NO: 3016 - DNA, 20 bp, synthetic construct
  source 1..20: mol_type = other DNA
gcctcgccctccccaaacag

SEQ ID NO: 3017 - DNA, 20 bp, synthetic construct
  source 1..20: mol_type = other DNA
gttaatgtttaatcagatag

SEQ ID NO: 3018 - DNA, 20 bp, synthetic construct
  source 1..20: mol_type = other DNA
agggtgtgggtgcttgacgc

SEQ ID NO: 3019 - DNA, 20 bp, synthetic construct
  source 1..20: mol_type = other DNA
gcagcgacgtcgaggcgctc

SEQ ID NO: 3020 - DNA, 20 bp, synthetic construct
  source 1..20: mol_type = other DNA
gttcagggtctgagcctgga

SEQ ID NO: 3021 - DNA, 20 bp, synthetic construct
  source 1..20: mol_type = other DNA
gggtctgagcctggaggagt

SEQ ID NO: 3022 - DNA, 20 bp, synthetic construct
  source 1..20: mol_type = other DNA
ggagcagggcgcgtgaaggg

SEQ ID NO: 3023 - DNA, 20 bp, synthetic construct
  source 1..20: mol_type = other DNA
gcgcgccccttcacgcgccc

SEQ ID NO: 3024 - DNA, 20 bp, synthetic construct
  source 1..20: mol_type = other DNA
cgcgccctgctcctgaactt

SEQ ID NO: 3025 - DNA, 20 bp, synthetic construct
  source 1..20: mol_type = other DNA
gctcctgcacagtcctcccc

SEQ ID NO: 3026 - DNA, 20 bp, synthetic construct
  source 1..20: mol_type = other DNA
cactgaatagcgcagccgca

SEQ ID NO: 3027 - DNA, 20 bp, synthetic construct
  source 1..20: mol_type = other DNA
gtgggaaggttcgcggggtt

SEQ ID NO: 3028 - DNA, 20 bp, synthetic construct
  source 1..20: mol_type = other DNA
cggggttgggagacccggag

SEQ ID NO: 3029 - DNA, 20 bp, synthetic construct
  source 1..20: mol_type = other DNA
tcggcctccgggtctcccaa

SEQ ID NO: 3030 - DNA, 20 bp, synthetic construct
  source 1..20: mol_type = other DNA
cagtacgttccaggcattca

SEQ ID NO: 3031 - DNA, 20 bp, synthetic construct
  source 1..20: mol_type = other DNA
gctgaaacagatggaatact

SEQ ID NO: 3032 - DNA, 20 bp, synthetic construct
  source 1..20: mol_type = other DNA
atctgtttcagccgaagaaa

SEQ ID NO: 3033 - DNA, 20 bp, synthetic construct
  source 1..20: mol_type = other DNA
tttcttcggctgaaacagat

SEQ ID NO: 3034 - DNA, 20 bp, synthetic construct
  source 1..20: mol_type = other DNA
gccgaagaaaagaaccagct

SEQ ID NO: 3035 - DNA, 20 bp, synthetic construct
  source 1..20: mol_type = other DNA
cgaggcccattggcgtcctt

SEQ ID NO: 3036 - DNA, 20 bp, synthetic construct
  source 1..20: mol_type = other DNA
tctcactagctgtggtgctt

SEQ ID NO: 3037 - DNA, 20 bp, synthetic construct
  source 1..20: mol_type = other DNA
gttgaccatgagtgaactta

SEQ ID NO: 3038 - DNA, 20 bp, synthetic construct
  source 1..20: mol_type = other DNA
ctggctctgcggcagaggct

SEQ ID NO: 3039 - DNA, 20 bp, synthetic construct
  source 1..20: mol_type = other DNA
tctgcactcgtggccactgg

SEQ ID NO: 3040 - DNA, 20 bp, synthetic construct
  source 1..20: mol_type = other DNA
tcatctgcactcgtggccac

SEQ ID NO: 3041 - DNA, 20 bp, synthetic construct
  source 1..20: mol_type = other DNA
agactgtgactacatttagt

SEQ ID NO: 3042 - DNA, 20 bp, synthetic construct
  source 1..20: mol_type = other DNA
tcaactatttagcagctacg

SEQ ID NO: 3043 - DNA, 20 bp, synthetic construct
  source 1..20: mol_type = other DNA
cagcgagttccccagcttga

SEQ ID NO: 3044 - DNA, 20 bp, synthetic construct
  source 1..20: mol_type = other DNA
gccctgagactttcctacag

SEQ ID NO: 3045 - DNA, 20 bp, synthetic construct
  source 1..20: mol_type = other DNA
gccccatcaggtgacccctt

SEQ ID NO: 3046 - DNA, 20 bp, synthetic construct
  source 1..20: mol_type = other DNA
ggaactgacctgactgagcc

SEQ ID NO: 3047 - DNA, 44 bp, synthetic construct
  source 1..44: mol_type = other DNA
aaataagagagaaaagaagagtaagaagaaatataagagccacc

SEQ ID NO: 3048 - DNA, 57 bp, synthetic construct
  source 1..57: mol_type = other DNA
atggcccctaagaagaagcgtaaagtgagccggggcggcagcggcggcggcagcgcc

SEQ ID NO: 3049 - DNA, 2931 bp, synthetic construct
  source 1..2931: mol_type = other DNA
caggagattaaacggatcaacaagatcagaagaagacttgtgaaagacagcaacaccaagaaggccggcaagacaggccccatgaaaaccctgctggttagagtgatgacacccgatctgagagagcggctggaaaacctgagaaagaagcctgaaaatatcccccagcccatcagcaatacatctagagccaacctgaataagctgctgaccgattacaccgaaatgaagaaggcgatcctgcatgtgtactgggaagagttccagaaggaccctgtgggcctgatgagccgggtggcccagcctgccagcaagaagatcgatcagaacaagctgaaacctgagatggacgagaagggcaacctgaccaccgccggctttgcctgctctcagtgtggccagcccctgttcgtgtacaagctggagcaggtgtctgagaagggcaaggcttacaccaactacttcggacggtgcaatgtggccgagcacgaaaagctgatcctgctggcccagctgaagcccgagaaggatagcgacgaagccgtgacatatagcctgggaaagtttgggcagagggccctggatttctacagcattcatgtgaccaaggagtccacccaccccgtgaagcccctggcccagatcgccggaaacagatacgcctccggacctgtgggaaaggccctgagcgacgcatgtatgggcacaatcgcctccttcctgtctaagtaccaggacatcatcatcgaacaccagaaggtggtgaagggcaaccagaagagactggagagcctgcgggagctggccggcaaggaaaacctggaataccctagcgtgaccctgccacctcagcctcacaccaaggagggcgttgatgcctacaacgaagtgatcgcccgggtgcgaatgtgggtgaacctgaacctgtggcagaagctgaagctaagcagagatgatgccaagcctctgctgagactgaagggattcccttcctttcctctggtcgagagacaggccaacgaagtggactggtgggacatggtgtgtaacgtgaagaagctgatcaacgagaaaaaggaggatggcaaggtgttttggcagaatctggctggctacaagagacaggaagccctgagaccatacctgagcagcgaggaagatcggaagaagggaaagaaattcgctcggtaccagctgggcgacctgctgctgcacctggaaaagaagcacggcgaggactggggaaaggtgtacgacgaggcctgggagcggattgacaagaaagtggaaggcctgagcaagcacatcaagctggaagaggaacggagaagcgaggacgcccagagcaaggccgccctgaccgactggctgcgggctaaggccagcttcgtgatcgagggcctgaaggaggccgacaaggacgagttctgcagatgcgagctgaagctgcagaagtggtacggggacctgcggggaaagcccttcgccatcgaagccgagaacagcatcctggacatcagcggcttcagcaagcagtacaactgtgccttcatctggcagaaggacggcgtgaagaagctgaacctgtacctgatcatcaactacttcaagggcggcaagctgcggttcaagaagatcaaacctgaagccttcgaagccaacagattctacaccgtgatcaacaaaaagagcggcgagatcgtgcccatggaggtgaacttcaacttcgacgaccccaacctgatcatcctgcctctggcctttggcaagagacagggcagagaattcatctggaacgacctgctgtccctggaaaccggcagcctgaagctggccaacggaagagtgatcgagaagacactgtacaacagaagaacccggcaggatgagcctgccctgttcgtggccctgaccttcgagcggcgggaggtcctggactcctccaatatcaaaccaatgaacctgatcggcgtggcaagaggcgaaaacatccccgccgtgatcgccctgaccgaccccgagggctgcccactgagccggtttaaggatagcctgggaaacccaacccacatcctgagaatcggcgagagctataaggagaagcagcggaccatccaggccaagaaggaggtggagcagcggagagccggcggctacagccggaagtacgccagcaaagccaagaatctggcagacgatatggtgagaaacaccgctagagatctgctgtactacgccgtgacccaggatgccatgctgatcttcgccaacctgagccggggcttcggccggcagggcaagcggaccttcatggccgagagacagtacacacggatggaggactggctgaccgccaagctggcctacgagggcctgagcaagacctacctgtccaagacactggcccagtacacctccaagacatgcagcaactgtgggtttaccatcaccagcgccgactacgacagggtgctggagaagctgaagaagacagcaacaggctggatgaccacaattaacggcaaggagctgaaggtggagggccagattacctactacaacagatacaagagacagaacgtagtcaaggacctgtccgtcgagctggatagactgagcgaagaatctgtgaacaacgacatctcctcctggacaaagggcagaagcggagaagctctgagcctcctgaagaaaagattctcccatagacccgtgcaggagaagttcgtgtgcctgaactgcggcttcgagacacacgcagccgagcaagccgccctgaacatcgccagatcctggctgttcctgcggagccaggagtacaagaaataccagacaaacaagacaaccggcaacaccgataagagagccttcgtcgagacctggcagtccttttaccggaagaagcttaaggaggtgtggaaacctgccgtg

SEQ ID NO: 3050 - DNA, 33 bp, synthetic construct
  source 1..33: mol_type = other DNA
cggtctggcggatctggcggaggctccacaagc

SEQ ID NO: 3051 - DNA, 300 bp, synthetic construct
  source 1..300: mol_type = other DNA
atgaacaactcccagggcagagtgaccttcgaggacgtgaccgtgaattttacacagggagagtggcagagactgaaccccgagcagagaaacctgtaccgggatgtgatgctggaaaactacagcaatctggtgtccgtgggccagggcgagaccacaaagcctgacgtgatcctgcgtctggagcagggcaaggaaccctggctggaggaggaggaggtgctgggaagcggacgggccgagaagaacggcgacatcggcggacagatctggaagcctaaggacgtgaaagaaagcctg

SEQ ID NO: 3052 - DNA, 27 bp, synthetic construct
  source 1..27: mol_type = other DNA
accagccccaagaaaaagagaaaagtc

SEQ ID NO: 3053 - DNA, 48 bp, synthetic construct
  source 1..48: mol_type = other DNA
gactacaaggatgacgatgacaaggactacaaggatgacgacgacaag

SEQ ID NO: 3054 - DNA, 26 bp, synthetic construct
  source 1..26: mol_type = other DNA
taatagataagcggccgcttaattaa

SEQ ID NO: 3055 - DNA, 93 bp, synthetic construct
  source 1..93: mol_type = other DNA
gctgccttctgcggggcttgccttctggccatgcccttcttctctcccttgcacctgtacctcttggtctttgaataaagcctgagtaggaag

SEQ ID NO: 3056 - skipped

SEQ ID NO: 3057 - RNA, 80 nt, synthetic construct
  source 1..80: mol_type = other RNA
aaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3058 - DNA, 60 bp, synthetic construct
  source 1..60: mol_type = other DNA
atggcccctaagaagaagcgtaaagtgagccgggtgaacggcagcggcagcggcggcggc

SEQ ID NO: 3059 - DNA, 906 bp, synthetic construct
  source 1..906: mol_type = other DNA
atgaaccacgaccaggagttcgacccccctaaggtgtaccctcccgtccccgccgagaagagaaagcccatccgggtcctgagcctgttcgatggcatcgccaccggtctgctggtgctgaaggacctgggcatccaggtggataggtacattgcctccgaggtgtgcgaggactccatcaccgtgggaatggtgcgtcatcagggcaagatcatgtacgtgggcgacgtgcggagcgtgacacagaagcatatccaggagtggggccctttcgacctggtgatcggcggcagcccttgcaatgacctgagcatcgtgaacccagcccggaagggcctgtacgagggaaccggcagactgttcttcgagttttacagactgctgcacgacgcccggcctaaggaaggcgacgaccggcccttcttttggctgttcgagaatgtggtggccatgggagtcagcgacaagcgggatattagccggttcctggagagcaaccccgtgatgatcgatgccaaggaagtgagcgccgcccaccgggccagatacttctggggcaatctgcctggcatgaacagacccctggccagcaccgtgaacgacaagctggagctgcaggagtgcctggagcacggccggatcgccaagttcagcaaggtgagaaccatcaccacccgaagcaacagcatcaaacaaggcaaggaccagcactttcctgtgttcatgaacgagaaggaggacatcctgtggtgtaccgagatggagagagtgttcgggttcccagtccactacacagatgtcagcaacatgtctagactggccagacagagactgctgggaagaagctggtccgtccctgtgatcagacacctgttcgcccctctgaaggagtacttcgcctgcgtg

SEQ ID NO: 3060 - DNA, 81 bp, synthetic construct
  source 1..81: mol_type = other DNA
agcagcggcaacagcaacgccaacagccggggccccagcttctctagcggcctggtgccactgtccctgagagggagccac

SEQ ID NO: 3061 - DNA, 645 bp, synthetic construct
  source 1..645: mol_type = other DNA
atgggccccatggagatctacaaaaccgtgagcgcctggaagcggcagcctgtgcgcgtgctgagcctgtttcggaatatcgataaagtcctgaaaagcctgggattcctggagagcggctctggctccggcggtggcaccctgaagtacgtggaggatgtgacaaacgtggtcagacgggatgtggagaagtggggccccttcgatctggtgtacggcagcacccaacccctgggcagctcttgtgaccggtgccctggctggtacatgtttcagttccaccggatcctgcagtacgccctgccgagacaggagtcccagcggccattcttttggattttcatggacaacttgctgctgaccgaggatgaccaggaaactaccactcggttcctgcagaccgaagccgtgaccctgcaggacgtgagaggccgggactaccagaacgccatgcgggtgtggtccaacatccctggactgaaaagcaagcacgcacctctgacccctaaagaagaggagtacctgcaggcccaggtgcggagcagaagcaagctggacgcccctaaggtggatctgctggtgaagaattgcctcctgcccctgagagagtacttcaagtatttcagccagaatagtctgcccctg

SEQ ID NO: 3062 - DNA, 264 bp, synthetic construct
  source 1..264: mol_type = other DNA
ggcggcccaagcagcggcgcccctcctcccagcggcggcagcccagccggctccccaacctctaccgaggagggcacctctgagtccgccacccccgagagcggccctggcacctccaccgagcccagcgagggcagcgcacccggcagccctgccggcagccccacctccacagaggagggaaccagcaccgagcccagcgaaggcagcgccccaggcaccagcaccgagcctagtgagggcggctctggcggcggcagcgcc

SEQ ID NO: 3063 - RNA, 3644 nt, synthetic construct
  source 1..3644: mol_type = other RNA
  modified_base order(4,22,32,34,46,53,65,70,109,110,118,127,139,140,142,184,193,196,199,200,205,208,218,220,232,241,254,260,262,274,281,285,287,298,302,307,310,317,318,328,340,343,347,349,351,354,363,364,377,379,385,388,397,407,421,425,436,443,448,466,480,481,482,486,489,491,495,497,508,510,511,514,516,523,532,534,536,551,552,561,564,565,573,578,580,598,601,604,607,616,632,646,651,653,658,666,667,668,682,686,687,688,690,697,698,701,703,714,727,736,745,759,765,773,775,787,798,800,802,811,816,819,820,823,825,827,831,841,844,847,862,865,886,895,904,922,927,932,937,943,950,956,973,974,977,981,991,994,1003,1009,1011,1015,1021,1027,1029,1039,1045,1055,1058,1067,1069,1072,1078,1086,1087,1091,1092,1095,1096,1097,1100,1102,1105,1126,1131,1134,1141,1144,1146,1148,1153,1162,1165,1184,1192,1194,1195,1196,1197,1205,1207,1211,1215,1234,1242,1246,1262,1281,1282,1286,1290,1297,1306,1309,1312,1318,1341,1351,1353,1365,1375,1376,1387,1396,1408,1414,1459,1467,1471,1478,1488,1489,1492,1495,1504,1527,1528,1530,1536,1543,1549,1557,1560,1570,1584,1585,1591,1609,1612,1618,1626,1627,1638,1644,1646,1650,1651,1654,1656,1672,1681,1687,1689,1693,1696,1699,1704,1707,1708,1723,1728,1729,1738,1745,1752,1753,1767,1768,1770,1777,1780,1801,1804,1810,1816,1821,1822,1827,1828,1843,1846,1849,1852,1856,1858,1863,1864,1865,1887,1888,1891,1893,1903,1906,1908,1912,1927,1933,1948,1951,1963,1965,1988,1994,1999,2001,2002,2005,2011,2016,2017,2032,2035,2040,2043,2048,2050,2059,2065,2068,2074,2092,2101,2104,2110,2127,2134,2142,2143,2144,2150,2155,2173,2176,2182,2193,2195,2215,2233,2256,2268,2288,2290,2300,2302,2305,2318,2324,2326,2329,2331,2334,2341,2351,2356,2359,2362,2364,2365,2374,2385,2386,2409,2410,2413,2427,2437,2445,2449,2461,2466,2476,2487,2491,2493,2503,2511,2517,2526,2535,2537,2541,2542,2543,2548,2562,2572,2575,2584,2604,2608,2617,2618,2632,2638,2650,2651,2655,2658,2667,2683,2686,2695,2697,2701,2707,2711,2716,2727,2729,2731,2743,2745,2748,2751,2777,2779,2785,2788,2799,2800,2802,2807,2815,2826,2827,2830,2832,2836,2841,2847,2848,2878,2884,2892,2895,2899,2901,2902,2905,2919,2928,2960,2970,2971,2974,2982,2988,2991,2992,2993,2994,3007,3008,3016,3018,3026,3031,3036,3038,3045,3047,3057,3067,3075,3088,3093,3094,3103,3109,3113,3114,3115,3116,3129,3139,3160,3162,3170,3172,3175,3178,3186,3194,3196,3199,3201,3205,3230,3235,3238,3241,3245,3247,3267,3271,3286,3289,3322,3334,3336,3344,3352,3364,3391,3396,3404,3410,3420,3428,3441,3444,3448,3459,3460,3463,3464,3469,3473,3474,3476,3484,3485,3489,3490,3492,3498,3503,3504,3506,3507,3509,3511,3515,3516,3522,3524,3528,3530,3531,3534,3536,3537,3538,3542,3549,3553,3560,3562): mod_base = m1f
aaataagagagaaaagaagagtaagaagaaatataagagccaccatggcccctaagaagaagcgtaaagtgagccggggcggcagcggcggcggcagcgcccaggagattaaacggatcaacaagatcagaagaagacttgtgaaagacagcaacaccaagaaggccggcaagacaggccccatgaaaaccctgctggttagagtgatgacacccgatctgagagagcggctggaaaacctgagaaagaagcctgaaaatatcccccagcccatcagcaatacatctagagccaacctgaataagctgctgaccgattacaccgaaatgaagaaggcgatcctgcatgtgtactgggaagagttccagaaggaccctgtgggcctgatgagccgggtggcccagcctgccagcaagaagatcgatcagaacaagctgaaacctgagatggacgagaagggcaacctgaccaccgccggctttgcctgctctcagtgtggccagcccctgttcgtgtacaagctggagcaggtgtctgagaagggcaaggcttacaccaactacttcggacggtgcaatgtggccgagcacgaaaagctgatcctgctggcccagctgaagcccgagaaggatagcgacgaagccgtgacatatagcctgggaaagtttgggcagagggccctggatttctacagcattcatgtgaccaaggagtccacccaccccgtgaagcccctggcccagatcgccggaaacagatacgcctccggacctgtgggaaaggccctgagcgacgcatgtatgggcacaatcgcctccttcctgtctaagtaccaggacatcatcatcgaacaccagaaggtggtgaagggcaaccagaagagactggagagcctgcgggagctggccggcaaggaaaacctggaataccctagcgtgaccctgccacctcagcctcacaccaaggagggcgttgatgcctacaacgaagtgatcgcccgggtgcgaatgtgggtgaacctgaacctgtggcagaagctgaagctaagcagagatgatgccaagcctctgctgagactgaagggattcccttcctttcctctggtcgagagacaggccaacgaagtggactggtgggacatggtgtgtaacgtgaagaagctgatcaacgagaaaaaggaggatggcaaggtgttttggcagaatctggctggctacaagagacaggaagccctgagaccatacctgagcagcgaggaagatcggaagaagggaaagaaattcgctcggtaccagctgggcgacctgctgctgcacctggaaaagaagcacggcgaggactggggaaaggtgtacgacgaggcctgggagcggattgacaagaaagtggaaggcctgagcaagcacatcaagctggaagaggaacggagaagcgaggacgcccagagcaaggccgccctgaccgactggctgcgggctaaggccagcttcgtgatcgagggcctgaaggaggccgacaaggacgagttctgcagatgcgagctgaagctgcagaagtggtacggggacctgcggggaaagcccttcgccatcgaagccgagaacagcatcctggacatcagcggcttcagcaagcagtacaactgtgccttcatctggcagaaggacggcgtgaagaagctgaacctgtacctgatcatcaactacttcaagggcggcaagctgcggttcaagaagatcaaacctgaagccttcgaagccaacagattctacaccgtgatcaacaaaaagagcggcgagatcgtgcccatggaggtgaacttcaacttcgacgaccccaacctgatcatcctgcctctggcctttggcaagagacagggcagagaattcatctggaacgacctgctgtccctggaaaccggcagcctgaagctggccaacggaagagtgatcgagaagacactgtacaacagaagaacccggcaggatgagcctgccctgttcgtggccctgaccttcgagcggcgggaggtcctggactcctccaatatcaaaccaatgaacctgatcggcgtggcaagaggcgaaaacatccccgccgtgatcgccctgaccgaccccgagggctgcccactgagccggtttaaggatagcctgggaaacccaacccacatcctgagaatcggcgagagctataaggagaagcagcggaccatccaggccaagaaggaggtggagcagcggagagccggcggctacagccggaagtacgccagcaaagccaagaatctggcagacgatatggtgagaaacaccgctagagatctgctgtactacgccgtgacccaggatgccatgctgatcttcgccaacctgagccggggcttcggccggcagggcaagcggaccttcatggccgagagacagtacacacggatggaggactggctgaccgccaagctggcctacgagggcctgagcaagacctacctgtccaagacactggcccagtacacctccaagacatgcagcaactgtgggtttaccatcaccagcgccgactacgacagggtgctggagaagctgaagaagacagcaacaggctggatgaccacaattaacggcaaggagctgaaggtggagggccagattacctactacaacagatacaagagacagaacgtagtcaaggacctgtccgtcgagctggatagactgagcgaagaatctgtgaacaacgacatctcctcctggacaaagggcagaagcggagaagctctgagcctcctgaagaaaagattctcccatagacccgtgcaggagaagttcgtgtgcctgaactgcggcttcgagacacacgcagccgagcaagccgccctgaacatcgccagatcctggctgttcctgcggagccaggagtacaagaaataccagacaaacaagacaaccggcaacaccgataagagagccttcgtcgagacctggcagtccttttaccggaagaagcttaaggaggtgtggaaacctgccgtgcggtctggcggatctggcggaggctccacaagcatgaacaactcccagggcagagtgaccttcgaggacgtgaccgtgaattttacacagggagagtggcagagactgaaccccgagcagagaaacctgtaccgggatgtgatgctggaaaactacagcaatctggtgtccgtgggccagggcgagaccacaaagcctgacgtgatcctgcgtctggagcagggcaaggaaccctggctggaggaggaggaggtgctgggaagcggacgggccgagaagaacggcgacatcggcggacagatctggaagcctaaggacgtgaaagaaagcctgaccagccccaagaaaaagagaaaagtcgactacaaggatgacgatgacaaggactacaaggatgacgacgacaagtaatagataagcggccgcttaattaagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3064 - RNA, 5543 nt, synthetic construct
  source 1..5543: mol_type = other RNA
  modified_base order(4,22,32,34,46,53,65,70,79,106,123,124,134,139,141,146,151,175,181,184,190,192,193,197,202,212,214,217,220,223,232,238,244,248,252,256,257,261,268,270,279,283,289,295,298,302,305,316,319,321,325,334,343,356,358,366,374,375,376,382,385,388,401,402,407,412,418,421,442,444,463,465,466,468,469,474,475,476,477,484,487,503,525,526,528,529,530,531,535,537,538,545,547,550,556,562,578,580,581,588,589,592,607,610,613,617,628,651,654,655,657,665,667,671,676,688,700,712,718,726,730,745,753,754,763,772,793,816,817,818,821,823,825,826,829,847,850,852,855,857,865,874,876,877,882,883,889,894,902,904,913,915,917,922,937,940,951,954,958,962,964,967,976,978,979,986,988,996,999,1000,1005,1009,1050,1051,1053,1055,1063,1066,1072,1074,1078,1093,1102,1108,1110,1120,1128,1142,1144,1150,1153,1159,1161,1162,1163,1169,1171,1175,1180,1183,1192,1197,1198,1201,1212,1214,1218,1226,1234,1239,1243,1250,1252,1261,1264,1274,1276,1284,1293,1294,1298,1300,1303,1305,1324,1332,1334,1335,1337,1344,1349,1353,1356,1360,1362,1363,1364,1368,1369,1378,1381,1386,1393,1407,1419,1420,1422,1423,1424,1425,1429,1430,1431,1432,1435,1443,1444,1447,1450,1460,1472,1478,1482,1483,1486,1501,1507,1516,1530,1543,1549,1551,1554,1561,1565,1570,1589,1591,1598,1611,1615,1627,1645,1655,1660,1664,1666,1669,1672,1679,1680,1684,1687,1693,1701,1704,1705,1710,1712,1713,1714,1724,1727,1729,1735,1760,1763,1788,1797,1799,1815,1817,1821,1844,1851,1889,1905,1970,1973,1983,1985,2008,2009,2017,2026,2038,2039,2041,2083,2092,2095,2098,2099,2104,2107,2117,2119,2131,2140,2153,2159,2161,2173,2180,2184,2186,2197,2201,2206,2209,2216,2217,2227,2239,2242,2246,2248,2250,2253,2262,2263,2276,2278,2284,2287,2296,2306,2320,2324,2335,2342,2347,2365,2379,2380,2381,2385,2388,2390,2394,2396,2407,2409,2410,2413,2415,2422,2431,2433,2435,2450,2451,2460,2463,2464,2472,2477,2479,2497,2500,2503,2506,2515,2531,2545,2550,2552,2557,2565,2566,2567,2581,2585,2586,2587,2589,2596,2597,2600,2602,2613,2626,2635,2644,2658,2664,2672,2674,2686,2697,2699,2701,2710,2715,2718,2719,2722,2724,2726,2730,2740,2743,2746,2761,2764,2785,2794,2803,2821,2826,2831,2836,2842,2849,2855,2872,2873,2876,2880,2890,2893,2902,2908,2910,2914,2920,2926,2928,2938,2944,2954,2957,2966,2968,2971,2977,2985,2986,2990,2991,2994,2995,2996,2999,3001,3004,3025,3030,3033,3040,3043,3045,3047,3052,3061,3064,3083,3091,3093,3094,3095,3096,3104,3106,3110,3114,3133,3141,3145,3161,3180,3181,3185,3189,3196,3205,3208,3211,3217,3240,3250,3252,3264,3274,3275,3286,3295,3307,3313,3358,3366,3370,3377,3387,3388,3391,3394,3403,3426,3427,3429,3435,3442,3448,3456,3459,3469,3483,3484,3490,3508,3511,3517,3525,3526,3537,3543,3545,3549,3550,3553,3555,3571,3580,3586,3588,3592,3595,3598,3603,3606,3607,3622,3627,3628,3637,3644,3651,3652,3666,3667,3669,3676,3679,3700,3703,3709,3715,3720,3721,3726,3727,3742,3745,3748,3751,3755,3757,3762,3763,3764,3786,3787,3790,3792,3802,3805,3807,3811,3826,3832,3847,3850,3862,3864,3887,3893,3898,3900,3901,3904,3910,3915,3916,3931,3934,3939,3942,3947,3949,3958,3964,3967,3973,3991,4000,4003,4009,4026,4033,4041,4042,4043,4049,4054,4072,4075,4081,4092,4094,4114,4132,4155,4167,4187,4189,4199,4201,4204,4217,4223,4225,4228,4230,4233,4240,4250,4255,4258,4261,4263,4264,4273,4284,4285,4308,4309,4312,4326,4336,4344,4348,4360,4365,4375,4386,4390,4392,4402,4410,4416,4425,4434,4436,4440,4441,4442,4447,4461,4471,4474,4483,4503,4507,4516,4517,4531,4537,4549,4550,4554,4557,4566,4582,4585,4594,4596,4600,4606,4610,4615,4626,4628,4630,4642,4644,4647,4650,4676,4678,4684,4687,4698,4699,4701,4706,4714,4725,4726,4729,4731,4735,4740,4746,4747,4777,4783,4791,4794,4798,4800,4801,4804,4818,4827,4859,4869,4870,4873,4881,4887,4890,4891,4892,4893,4906,4907,4915,4917,4925,4930,4935,4937,4944,4946,4956,4966,4974,4987,4992,4993,5002,5008,5012,5013,5014,5015,5028,5038,5059,5061,5069,5071,5074,5077,5085,5093,5095,5098,5100,5104,5129,5134,5137,5140,5144,5146,5166,5170,5185,5188,5221,5233,5235,5243,5251,5263,5290,5295,5303,5309,5319,5327,5340,5343,5347,5358,5359,5362,5363,5368,5372,5373,5375,5383,5384,5388,5389,5391,5397,5402,5403,5405,5406,5408,5410,5414,5415,5421,5423,5427,5429,5430,5433,5435,5436,5437,5441,5448,5452,5459,5461): mod_base = m1f
aaataagagagaaaagaagagtaagaagaaatataagagccaccatggcccctaagaagaagcgtaaagtgagccgggtgaacggcagcggcagcggcggcggcatgaaccacgaccaggagttcgacccccctaaggtgtaccctcccgtccccgccgagaagagaaagcccatccgggtcctgagcctgttcgatggcatcgccaccggtctgctggtgctgaaggacctgggcatccaggtggataggtacattgcctccgaggtgtgcgaggactccatcaccgtgggaatggtgcgtcatcagggcaagatcatgtacgtgggcgacgtgcggagcgtgacacagaagcatatccaggagtggggccctttcgacctggtgatcggcggcagcccttgcaatgacctgagcatcgtgaacccagcccggaagggcctgtacgagggaaccggcagactgttcttcgagttttacagactgctgcacgacgcccggcctaaggaaggcgacgaccggcccttcttttggctgttcgagaatgtggtggccatgggagtcagcgacaagcgggatattagccggttcctggagagcaaccccgtgatgatcgatgccaaggaagtgagcgccgcccaccgggccagatacttctggggcaatctgcctggcatgaacagacccctggccagcaccgtgaacgacaagctggagctgcaggagtgcctggagcacggccggatcgccaagttcagcaaggtgagaaccatcaccacccgaagcaacagcatcaaacaaggcaaggaccagcactttcctgtgttcatgaacgagaaggaggacatcctgtggtgtaccgagatggagagagtgttcgggttcccagtccactacacagatgtcagcaacatgtctagactggccagacagagactgctgggaagaagctggtccgtccctgtgatcagacacctgttcgcccctctgaaggagtacttcgcctgcgtgagcagcggcaacagcaacgccaacagccggggccccagcttctctagcggcctggtgccactgtccctgagagggagccacatgggccccatggagatctacaaaaccgtgagcgcctggaagcggcagcctgtgcgcgtgctgagcctgtttcggaatatcgataaagtcctgaaaagcctgggattcctggagagcggctctggctccggcggtggcaccctgaagtacgtggaggatgtgacaaacgtggtcagacgggatgtggagaagtggggccccttcgatctggtgtacggcagcacccaacccctgggcagctcttgtgaccggtgccctggctggtacatgtttcagttccaccggatcctgcagtacgccctgccgagacaggagtcccagcggccattcttttggattttcatggacaacttgctgctgaccgaggatgaccaggaaactaccactcggttcctgcagaccgaagccgtgaccctgcaggacgtgagaggccgggactaccagaacgccatgcgggtgtggtccaacatccctggactgaaaagcaagcacgcacctctgacccctaaagaagaggagtacctgcaggcccaggtgcggagcagaagcaagctggacgcccctaaggtggatctgctggtgaagaattgcctcctgcccctgagagagtacttcaagtatttcagccagaatagtctgcccctgggcggcccaagcagcggcgcccctcctcccagcggcggcagcccagccggctccccaacctctaccgaggagggcacctctgagtccgccacccccgagagcggccctggcacctccaccgagcccagcgagggcagcgcacccggcagccctgccggcagccccacctccacagaggagggaaccagcaccgagcccagcgaaggcagcgccccaggcaccagcaccgagcctagtgagggcggctctggcggcggcagcgcccaggagattaaacggatcaacaagatcagaagaagacttgtgaaagacagcaacaccaagaaggccggcaagacaggccccatgaaaaccctgctggttagagtgatgacacccgatctgagagagcggctggaaaacctgagaaagaagcctgaaaatatcccccagcccatcagcaatacatctagagccaacctgaataagctgctgaccgattacaccgaaatgaagaaggcgatcctgcatgtgtactgggaagagttccagaaggaccctgtgggcctgatgagccgggtggcccagcctgccagcaagaagatcgatcagaacaagctgaaacctgagatggacgagaagggcaacctgaccaccgccggctttgcctgctctcagtgtggccagcccctgttcgtgtacaagctggagcaggtgtctgagaagggcaaggcttacaccaactacttcggacggtgcaatgtggccgagcacgaaaagctgatcctgctggcccagctgaagcccgagaaggatagcgacgaagccgtgacatatagcctgggaaagtttgggcagagggccctggatttctacagcattcatgtgaccaaggagtccacccaccccgtgaagcccctggcccagatcgccggaaacagatacgcctccggacctgtgggaaaggccctgagcgacgcatgtatgggcacaatcgcctccttcctgtctaagtaccaggacatcatcatcgaacaccagaaggtggtgaagggcaaccagaagagactggagagcctgcgggagctggccggcaaggaaaacctggaataccctagcgtgaccctgccacctcagcctcacaccaaggagggcgttgatgcctacaacgaagtgatcgcccgggtgcgaatgtgggtgaacctgaacctgtggcagaagctgaagctaagcagagatgatgccaagcctctgctgagactgaagggattcccttcctttcctctggtcgagagacaggccaacgaagtggactggtgggacatggtgtgtaacgtgaagaagctgatcaacgagaaaaaggaggatggcaaggtgttttggcagaatctggctggctacaagagacaggaagccctgagaccatacctgagcagcgaggaagatcggaagaagggaaagaaattcgctcggtaccagctgggcgacctgctgctgcacctggaaaagaagcacggcgaggactggggaaaggtgtacgacgaggcctgggagcggattgacaagaaagtggaaggcctgagcaagcacatcaagctggaagaggaacggagaagcgaggacgcccagagcaaggccgccctgaccgactggctgcgggctaaggccagcttcgtgatcgagggcctgaaggaggccgacaaggacgagttctgcagatgcgagctgaagctgcagaagtggtacggggacctgcggggaaagcccttcgccatcgaagccgagaacagcatcctggacatcagcggcttcagcaagcagtacaactgtgccttcatctggcagaaggacggcgtgaagaagctgaacctgtacctgatcatcaactacttcaagggcggcaagctgcggttcaagaagatcaaacctgaagccttcgaagccaacagattctacaccgtgatcaacaaaaagagcggcgagatcgtgcccatggaggtgaacttcaacttcgacgaccccaacctgatcatcctgcctctggcctttggcaagagacagggcagagaattcatctggaacgacctgctgtccctggaaaccggcagcctgaagctggccaacggaagagtgatcgagaagacactgtacaacagaagaacccggcaggatgagcctgccctgttcgtggccctgaccttcgagcggcgggaggtcctggactcctccaatatcaaaccaatgaacctgatcggcgtggcaagaggcgaaaacatccccgccgtgatcgccctgaccgaccccgagggctgcccactgagccggtttaaggatagcctgggaaacccaacccacatcctgagaatcggcgagagctataaggagaagcagcggaccatccaggccaagaaggaggtggagcagcggagagccggcggctacagccggaagtacgccagcaaagccaagaatctggcagacgatatggtgagaaacaccgctagagatctgctgtactacgccgtgacccaggatgccatgctgatcttcgccaacctgagccggggcttcggccggcagggcaagcggaccttcatggccgagagacagtacacacggatggaggactggctgaccgccaagctggcctacgagggcctgagcaagacctacctgtccaagacactggcccagtacacctccaagacatgcagcaactgtgggtttaccatcaccagcgccgactacgacagggtgctggagaagctgaagaagacagcaacaggctggatgaccacaattaacggcaaggagctgaaggtggagggccagattacctactacaacagatacaagagacagaacgtagtcaaggacctgtccgtcgagctggatagactgagcgaagaatctgtgaacaacgacatctcctcctggacaaagggcagaagcggagaagctctgagcctcctgaagaaaagattctcccatagacccgtgcaggagaagttcgtgtgcctgaactgcggcttcgagacacacgcagccgagcaagccgccctgaacatcgccagatcctggctgttcctgcggagccaggagtacaagaaataccagacaaacaagacaaccggcaacaccgataagagagccttcgtcgagacctggcagtccttttaccggaagaagcttaaggaggtgtggaaacctgccgtgcggtctggcggatctggcggaggctccacaagcatgaacaactcccagggcagagtgaccttcgaggacgtgaccgtgaattttacacagggagagtggcagagactgaaccccgagcagagaaacctgtaccgggatgtgatgctggaaaactacagcaatctggtgtccgtgggccagggcgagaccacaaagcctgacgtgatcctgcgtctggagcagggcaaggaaccctggctggaggaggaggaggtgctgggaagcggacgggccgagaagaacggcgacatcggcggacagatctggaagcctaaggacgtgaaagaaagcctgaccagccccaagaaaaagagaaaagtcgactacaaggatgacgatgacaaggactacaaggatgacgacgacaagtaatagataagcggccgcttaattaagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3065 - protein, 1116 aa, synthetic construct
MAPKKKRKVSRGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLTSPKKKRKV

SEQ ID NO: 3066 - protein, 1749 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLTSPKKKRKV

SEQ ID NO: 3067 - RNA, 20 nt, synthetic construct
  source 1..20: mol_type = other RNA
gcctcgccctccccagacag

SEQ ID NO: 3068 - RNA, 20 nt, synthetic construct
  source 1..20: mol_type = other RNA
cgctacctgcctaaactttg

SEQ ID NO: 3069 - RNA, 20 nt, synthetic construct
  source 1..20: mol_type = other RNA
ccctccaacaatattaacta

SEQ ID NO: 3070 - RNA, 20 nt, synthetic construct
  source 1..20: mol_type = other RNA
ggggtctcccagccacccct

SEQ ID NO: 3071 - RNA, 20 nt, synthetic construct
  source 1..20: mol_type = other RNA
cccctcttaatccccactcc

SEQ ID NO: 3072 - RNA, 20 nt, synthetic construct
  source 1..20: mol_type = other RNA
ctctctctttctgaggctag

SEQ ID NO: 3073 - RNA, 20 nt, synthetic construct
  source 1..20: mol_type = other RNA
taatctccatcctcgtcctg

SEQ ID NO: 3074 - RNA, 109 nt, synthetic construct
  modified_base 1..4: mod_base = OTHER; note = linked by phosphorothioate
  modified_base 1: mod_base = OTHER; note = 2'-O-methyl adenosine
  modified_base 2: mod_base = cm
  modified_base 3: mod_base = um
  modified_base 106..109: mod_base = OTHER; note = linked by phosphorothioate
  modified_base 107: mod_base = OTHER; note = 2'-O-methyl adenosine
  modified_base 108: mod_base = gm
  modified_base 109: mod_base = OTHER; note = 2'-O-methyl adenosine
  source 1..109: mol_type = other RNA
actggcgcttttatctgattactttgagagccatcaccagcgactatgtcgtagtgggtaaagctccctcttcggagggagcatcaaagtcctggcttcctggtgaaga

SEQ ID NO: 3075 - RNA, 109 nt, synthetic construct
  modified_base 1..4: mod_base = OTHER; note = linked by phosphorothioate
  modified_base 1: mod_base = OTHER; note = 2'-O-methyl adenosine
  modified_base 2: mod_base = cm
  modified_base 3: mod_base = um
  modified_base 106..109: mod_base = OTHER; note = linked by phosphorothioate
  modified_base 107: mod_base = cm
  modified_base 108: mod_base = OTHER; note = 2'-O-methyl adenosine
  modified_base 109: mod_base = gm
  source 1..109: mol_type = other RNA
actggcgcttttatctgattactttgagagccatcaccagcgactatgtcgtagtgggtaaagctccctcttcggagggagcatcaaaggcctcgccctccccagacag

SEQ ID NO: 3076 - RNA, 109 nt, synthetic construct
  modified_base 1..4: mod_base = OTHER; note = linked by phosphorothioate
  modified_base 1: mod_base = OTHER; note = 2'-O-methyl adenosine
  modified_base 2: mod_base = cm
  modified_base 3: mod_base = um
  modified_base 106..109: mod_base = OTHER; note = linked by phosphorothioate
  modified_base 107: mod_base = um
  modified_base 108: mod_base = um
  modified_base 109: mod_base = gm
  source 1..109: mol_type = other RNA
actggcgcttttatctgattactttgagagccatcaccagcgactatgtcgtagtgggtaaagctccctcttcggagggagcatcaaagcgctacctgcctaaactttg

SEQ ID NO: 3077 - RNA, 109 nt, synthetic construct
  modified_base 1..4: mod_base = OTHER; note = linked by phosphorothioate
  modified_base 1: mod_base = OTHER; note = 2'-O-methyl adenosine
  modified_base 2: mod_base = cm
  modified_base 3: mod_base = um
  modified_base 106..109: mod_base = OTHER; note = linked by phosphorothioate
  modified_base 107: mod_base = cm
  modified_base 108: mod_base = um
  modified_base 109: mod_base = OTHER; note = 2'-O-methyl adenosine
  source 1..109: mol_type = other RNA
actggcgcttttatctgattactttgagagccatcaccagcgactatgtcgtagtgggtaaagctccctcttcggagggagcatcaaagccctccaacaatattaacta

SEQ ID NO: 3078 - RNA, 109 nt, synthetic construct
  modified_base 1..4: mod_base = OTHER; note = linked by phosphorothioate
  modified_base 1: mod_base = OTHER; note = 2'-O-methyl adenosine
  modified_base 2: mod_base = cm
  modified_base 3: mod_base = um
  modified_base 106..109: mod_base = OTHER; note = linked by phosphorothioate
  modified_base 107: mod_base = cm
  modified_base 108: mod_base = cm
  modified_base 109: mod_base = um
  source 1..109: mol_type = other RNA
actggcgcttttatctgattactttgagagccatcaccagcgactatgtcgtagtgggtaaagctccctcttcggagggagcatcaaagggggtctcccagccacccct

SEQ ID NO: 3079 - RNA, 109 nt, synthetic construct
  modified_base 1..4: mod_base = OTHER; note = linked by phosphorothioate
  modified_base 1: mod_base = OTHER; note = 2'-O-methyl adenosine
  modified_base 2: mod_base = cm
  modified_base 3: mod_base = um
  modified_base 106..109: mod_base = OTHER; note = linked by phosphorothioate
  modified_base 107: mod_base = um
  modified_base 108: mod_base = cm
  modified_base 109: mod_base = cm
  source 1..109: mol_type = other RNA
actggcgcttttatctgattactttgagagccatcaccagcgactatgtcgtagtgggtaaagctccctcttcggagggagcatcaaagcccctcttaatccccactcc

SEQ ID NO: 3080 - RNA, 109 nt, synthetic construct
  modified_base 1..4: mod_base = OTHER; note = linked by phosphorothioate
  modified_base 1: mod_base = OTHER; note = 2'-O-methyl adenosine
  modified_base 2: mod_base = cm
  modified_base 3: mod_base = um
  modified_base 106..109: mod_base = OTHER; note = linked by phosphorothioate
  modified_base 107: mod_base = um
  modified_base 108: mod_base = OTHER; note = 2'-O-methyl adenosine
  modified_base 109: mod_base = gm
  source 1..109: mol_type = other RNA
actggcgcttttatctgattactttgagagccatcaccagcgactatgtcgtagtgggtaaagctccctcttcggagggagcatcaaagctctctctttctgaggctag

SEQ ID NO: 3081 - RNA, 109 nt, synthetic construct
  modified_base 1..4: mod_base = OTHER; note = linked by phosphorothioate
  modified_base 1: mod_base = OTHER; note = 2'-O-methyl adenosine
  modified_base 2: mod_base = cm
  modified_base 3: mod_base = um
  modified_base 106..109: mod_base = OTHER; note = linked by phosphorothioate
  modified_base 107: mod_base = cm
  modified_base 108: mod_base = um
  modified_base 109: mod_base = gm
  source 1..109: mol_type = other RNA
actggcgcttttatctgattactttgagagccatcaccagcgactatgtcgtagtgggtaaagctccctcttcggagggagcatcaaagtaatctccatcctcgtcctg

SEQ ID NO: 3082 - RNA, 14 nt, synthetic construct
  source 1..14: mol_type = other RNA
gaccggccgccacc

SEQ ID NO: 3083 - DNA, 60 bp, synthetic construct
  source 1..60: mol_type = other DNA
atggccccaaagaagaagcggaaggtctctagagttaacggatcaggctctggaggtgga

SEQ ID NO: 3084 - DNA, 906 bp, synthetic construct
  source 1..906: mol_type = other DNA
atgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtg

SEQ ID NO: 3085 - DNA, 81 bp, synthetic construct
  source 1..81: mol_type = other DNA
tctagcggcaatagtaacgctaacagccgcgggccgagcttcagcagcggcctggtgccgttaagcttgcgcggcagccat

SEQ ID NO: 3086 - DNA, 645 bp, synthetic construct
  source 1..645: mol_type = other DNA
atgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctctt

SEQ ID NO: 3087 - DNA, 240 bp, synthetic construct
  source 1..240: mol_type = other DNA
ggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgag

SEQ ID NO: 3088 - DNA, 24 bp, synthetic construct
  source 1..24: mol_type = other DNA
ggcggttccggcggaggaagcgct

SEQ ID NO: 3089 - DNA, 2931 bp, synthetic construct
  source 1..2931: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 3090 - DNA, 33 bp, synthetic construct
  source 1..33: mol_type = other DNA
cgatcgggcggttccggcggaggttccactagt

SEQ ID NO: 3091 - DNA, 300 bp, synthetic construct
  source 1..300: mol_type = other DNA
atgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctc

SEQ ID NO: 3092 - DNA, 27 bp, synthetic construct
  source 1..27: mol_type = other DNA
actagtccaaaaaagaagagaaaggta

SEQ ID NO: 3093 - DNA, 48 bp, synthetic construct
  source 1..48: mol_type = other DNA
gattacaaagatgacgatgacaaagactacaaggatgatgatgataag

SEQ ID NO: 3094 - DNA, 11 bp, synthetic construct
  source 1..11: mol_type = other DNA
ggatccggctg

SEQ ID NO: 3095 - RNA, 121 nt, synthetic construct
  source 1..121: mol_type = other RNA
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3096 - DNA, 33 bp, synthetic construct
  source 1..33: mol_type = other DNA
atggccccaaagaagaagcggaaggtctctaga

SEQ ID NO: 3097 - DNA, 18 bp, synthetic construct
  source 1..18: mol_type = other DNA
ggcggttccggcggagga

SEQ ID NO: 3098 - DNA, 21 bp, synthetic construct
  source 1..21: mol_type = other DNA
ccaaaaaagaagagaaaggta

SEQ ID NO: 3099 - RNA, 5441 nt, synthetic construct
  source 1..5441: mol_type = other RNA
  modified_base order(16,40,42,44,49,50,57,63,65,71,76,83,93,94,95,109,110,111,119,121,128,145,151,154,156,158,160,162,163,164,167,172,173,176,184,187,190,193,202,208,214,222,226,231,238,240,242,249,253,259,265,268,286,289,291,295,304,313,326,328,336,345,346,352,355,358,359,368,372,382,384,388,389,391,398,412,413,414,416,422,425,433,435,436,438,439,440,444,445,447,454,457,461,464,485,488,495,496,498,499,501,505,507,508,509,515,517,520,526,532,533,536,550,552,558,559,560,562,563,567,569,577,580,583,584,598,600,602,605,620,621,624,625,627,632,637,638,641,646,656,657,658,663,668,670,674,677,682,688,696,698,700,715,723,724,733,742,743,753,759,761,763,785,786,787,793,795,796,799,817,820,822,825,830,835,844,846,847,848,852,853,859,864,874,876,883,891,892,907,910,918,921,928,934,937,946,948,949,953,958,966,968,969,970,971,974,975,977,979,981,983,992,995,1001,1020,1021,1033,1036,1041,1042,1047,1048,1061,1063,1070,1072,1078,1080,1090,1092,1094,1098,1114,1120,1123,1129,1131,1132,1141,1150,1153,1160,1161,1162,1167,1168,1170,1171,1181,1182,1184,1187,1188,1190,1204,1209,1213,1220,1222,1229,1231,1234,1246,1254,1263,1264,1265,1270,1273,1275,1281,1294,1302,1304,1305,1307,1310,1314,1316,1323,1326,1330,1332,1333,1338,1339,1348,1351,1356,1358,1363,1367,1379,1389,1390,1392,1393,1395,1399,1401,1402,1405,1412,1414,1417,1420,1424,1430,1445,1452,1453,1456,1457,1469,1471,1477,1484,1486,1490,1500,1508,1511,1513,1519,1521,1531,1532,1540,1553,1561,1581,1583,1585,1597,1615,1630,1631,1636,1639,1642,1650,1654,1655,1657,1663,1671,1674,1675,1680,1682,1683,1684,1685,1686,1688,1695,1699,1700,1703,1705,1706,1719,1721,1739,1746,1748,1751,1758,1767,1769,1772,1791,1806,1814,1817,1821,1833,1835,1841,1844,1850,1853,1854,1862,1871,1874,1875,1893,1907,1914,1916,1922,1934,1941,1943,1952,1953,1970,1978,1987,1996,2008,2011,2053,2062,2065,2068,2074,2077,2084,2089,2101,2110,2131,2135,2141,2143,2167,2176,2179,2187,2197,2209,2212,2218,2220,2223,2232,2233,2248,2254,2257,2266,2267,2270,2276,2290,2305,2317,2333,2335,2349,2350,2351,2355,2358,2360,2364,2366,2375,2377,2379,2380,2383,2385,2392,2401,2403,2421,2430,2433,2434,2442,2444,2449,2467,2470,2471,2473,2476,2485,2492,2502,2504,2507,2515,2520,2527,2535,2536,2537,2551,2556,2557,2559,2566,2572,2596,2605,2609,2614,2624,2628,2634,2636,2642,2644,2656,2658,2663,2667,2671,2680,2688,2689,2692,2700,2710,2713,2716,2731,2734,2755,2764,2773,2791,2796,2806,2812,2816,2819,2825,2842,2850,2860,2863,2872,2878,2880,2884,2890,2896,2898,2908,2914,2916,2936,2938,2941,2947,2955,2956,2960,2964,2965,2969,2971,2974,2990,2995,2999,3000,3003,3010,3013,3015,3022,3031,3034,3053,3061,3062,3063,3064,3066,3076,3084,3103,3110,3111,3115,3150,3151,3159,3166,3175,3178,3181,3187,3210,3220,3222,3227,3234,3244,3256,3265,3277,3278,3283,3315,3317,3326,3328,3335,3336,3340,3357,3358,3359,3361,3364,3373,3396,3397,3399,3405,3412,3418,3426,3429,3437,3439,3453,3454,3460,3461,3478,3481,3487,3495,3496,3507,3513,3519,3520,3523,3524,3525,3541,3550,3556,3558,3562,3565,3568,3572,3573,3576,3577,3592,3597,3598,3607,3621,3622,3629,3636,3637,3639,3646,3649,3660,3670,3673,3679,3685,3690,3691,3696,3697,3712,3715,3716,3718,3721,3725,3727,3732,3733,3756,3757,3760,3762,3770,3772,3775,3781,3792,3794,3796,3802,3809,3817,3820,3832,3834,3863,3866,3868,3870,3871,3872,3874,3880,3885,3886,3901,3904,3919,3928,3934,3937,3943,3959,3961,3965,3968,3970,3973,3979,3989,3996,4003,4011,4012,4020,4024,4034,4042,4045,4051,4062,4084,4102,4125,4128,4130,4137,4157,4159,4171,4174,4193,4195,4198,4200,4203,4210,4225,4228,4231,4233,4234,4241,4243,4254,4255,4278,4279,4280,4282,4296,4306,4313,4314,4318,4325,4330,4335,4345,4356,4360,4362,4372,4380,4382,4386,4395,4403,4404,4410,4411,4417,4431,4441,4444,4453,4473,4477,4486,4501,4507,4508,4519,4524,4527,4536,4552,4555,4562,4564,4570,4576,4585,4600,4612,4620,4635,4646,4648,4654,4657,4668,4669,4670,4682,4684,4695,4696,4699,4701,4705,4710,4716,4717,4733,4742,4747,4753,4754,4764,4768,4770,4771,4774,4788,4797,4839,4840,4841,4843,4851,4860,4861,4863,4876,4885,4887,4900,4905,4913,4914,4925,4926,4931,4934,4936,4943,4944,4957,4962,4963,4970,4972,4976,4978,4983,4984,4998,5008,5012,5028,5029,5031,5039,5041,5044,5047,5054,5055,5065,5066,5068,5070,5072,5074,5102,5104,5107,5109,5110,5115,5116,5136,5139,5140,5155,5158,5165,5171,5183,5191,5192,5203,5204,5205,5219,5221,5231,5233,5237,5240,5260,5264,5265,5273,5279,5289,5297,5300,5303,5306,5313,5319): mod_base = m1f
gaccggccgccaccatggccccaaagaagaagcggaaggtctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcactagtccaaaaaagaagagaaaggtagattacaaagatgacgatgacaaagactacaaggatgatgatgataagggatccggctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3100 - RNA, 5402 nt, synthetic construct
  source 1..5402: mol_type = other RNA
  modified_base order(16,40,42,44,49,56,66,67,68,82,83,84,92,94,101,118,124,127,129,131,133,135,136,137,140,145,146,149,157,160,163,166,175,181,187,195,199,204,211,213,215,222,226,232,238,241,259,262,264,268,277,286,299,301,309,318,319,325,328,331,332,341,345,355,357,361,362,364,371,385,386,387,389,395,398,406,408,409,411,412,413,417,418,420,427,430,434,437,458,461,468,469,471,472,474,478,480,481,482,488,490,493,499,505,506,509,523,525,531,532,533,535,536,540,542,550,553,556,557,571,573,575,578,593,594,597,598,600,605,610,611,614,619,629,630,631,636,641,643,647,650,655,661,669,671,673,688,696,697,706,715,716,726,732,734,736,758,759,760,766,768,769,772,790,793,795,798,803,808,817,819,820,821,825,826,832,837,847,849,856,864,865,880,883,891,894,901,907,910,919,921,922,926,931,939,941,942,943,944,947,948,950,952,954,956,965,968,974,993,994,1006,1009,1014,1015,1020,1021,1034,1036,1043,1045,1051,1053,1063,1065,1067,1071,1087,1093,1096,1102,1104,1105,1114,1123,1126,1133,1134,1135,1140,1141,1143,1144,1154,1155,1157,1160,1161,1163,1177,1182,1186,1193,1195,1202,1204,1207,1219,1227,1236,1237,1238,1243,1246,1248,1254,1267,1275,1277,1278,1280,1283,1287,1289,1296,1299,1303,1305,1306,1311,1312,1321,1324,1329,1331,1336,1340,1352,1362,1363,1365,1366,1368,1372,1374,1375,1378,1385,1387,1390,1393,1397,1403,1418,1425,1426,1429,1430,1442,1444,1450,1457,1459,1463,1473,1481,1484,1486,1492,1494,1504,1505,1513,1526,1534,1554,1556,1558,1570,1588,1603,1604,1609,1612,1615,1623,1627,1628,1630,1636,1644,1647,1648,1653,1655,1656,1657,1658,1659,1661,1668,1672,1673,1676,1678,1679,1685,1686,1699,1706,1707,1720,1725,1726,1733,1735,1739,1741,1746,1747,1761,1771,1775,1791,1792,1794,1802,1804,1807,1810,1817,1818,1828,1829,1831,1833,1835,1837,1865,1867,1870,1872,1873,1878,1879,1899,1902,1903,1918,1921,1928,1934,1946,1954,1955,1966,1967,1968,1982,1984,1994,1996,2010,2012,2030,2037,2039,2042,2049,2058,2060,2063,2082,2097,2105,2108,2112,2124,2126,2132,2135,2141,2144,2145,2153,2162,2165,2166,2184,2198,2205,2207,2213,2225,2232,2234,2245,2254,2263,2275,2278,2320,2329,2332,2335,2341,2344,2351,2356,2368,2377,2398,2402,2408,2410,2434,2443,2446,2454,2464,2476,2479,2485,2487,2490,2499,2500,2515,2521,2524,2533,2534,2537,2543,2557,2572,2584,2600,2602,2616,2617,2618,2622,2625,2627,2631,2633,2642,2644,2646,2647,2650,2652,2659,2668,2670,2688,2697,2700,2701,2709,2711,2716,2734,2737,2738,2740,2743,2752,2759,2769,2771,2774,2782,2787,2794,2802,2803,2804,2818,2823,2824,2826,2833,2839,2863,2872,2876,2881,2891,2895,2901,2903,2909,2911,2923,2925,2930,2934,2938,2947,2955,2956,2959,2967,2977,2980,2983,2998,3001,3022,3031,3040,3058,3063,3073,3079,3083,3086,3092,3109,3117,3127,3130,3139,3145,3147,3151,3157,3163,3165,3175,3181,3183,3203,3205,3208,3214,3222,3223,3227,3231,3232,3236,3238,3241,3257,3262,3266,3267,3270,3277,3280,3282,3289,3298,3301,3320,3328,3329,3330,3331,3333,3343,3351,3370,3377,3378,3382,3417,3418,3426,3433,3442,3445,3448,3454,3477,3487,3489,3494,3501,3511,3523,3532,3544,3545,3550,3582,3584,3593,3595,3602,3603,3607,3624,3625,3626,3628,3631,3640,3663,3664,3666,3672,3679,3685,3693,3696,3704,3706,3720,3721,3727,3728,3745,3748,3754,3762,3763,3774,3780,3786,3787,3790,3791,3792,3808,3817,3823,3825,3829,3832,3835,3839,3840,3843,3844,3859,3864,3865,3874,3888,3889,3896,3903,3904,3906,3913,3916,3927,3937,3940,3946,3952,3957,3958,3963,3964,3979,3982,3983,3985,3988,3992,3994,3999,4000,4023,4024,4027,4029,4037,4039,4042,4048,4059,4061,4063,4069,4076,4084,4087,4099,4101,4130,4133,4135,4137,4138,4139,4141,4147,4152,4153,4168,4171,4186,4195,4201,4204,4210,4226,4228,4232,4235,4237,4240,4246,4256,4263,4270,4278,4279,4287,4291,4301,4309,4312,4318,4329,4351,4369,4392,4395,4397,4404,4424,4426,4438,4441,4460,4462,4465,4467,4470,4477,4492,4495,4498,4500,4501,4508,4510,4521,4522,4545,4546,4547,4549,4563,4573,4580,4581,4585,4592,4597,4602,4612,4623,4627,4629,4639,4647,4649,4653,4662,4670,4671,4677,4678,4684,4698,4708,4711,4720,4740,4744,4753,4768,4774,4775,4786,4791,4794,4803,4819,4822,4829,4831,4837,4843,4852,4867,4879,4887,4902,4913,4915,4921,4924,4935,4936,4937,4949,4951,4962,4963,4966,4968,4972,4977,4983,4984,5000,5009,5014,5020,5021,5031,5035,5037,5038,5041,5055,5064,5106,5107,5108,5110,5118,5127,5128,5130,5143,5152,5154,5167,5172,5180,5181,5192,5193,5198,5201,5221,5225,5226,5234,5240,5250,5258,5261,5264,5267,5274,5280): mod_base = m1f
gaccggccgccaccatggccccaaagaagaagcggaaggtctctagaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggtagattacaaagatgacgatgacaaagactacaaggatgatgatgataagggatccggctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3101 - RNA, 20 nt, synthetic construct
  source 1..20: mol_type = other RNA
cgcgagcacagctaaggcca

SEQ ID NO: 3102 - RNA, 20 nt, synthetic construct
  source 1..20: mol_type = other RNA
cacgccaccccgagccccat

SEQ ID NO: 3103 - RNA, 20 nt, synthetic construct
  source 1..20: mol_type = other RNA
cagcctgcgcgtccacgtga

SEQ ID NO: 3104 - DNA, 33 bp, synthetic construct
  source 1..33: mol_type = other DNA
atggcccctaagaagaagcgtaaagtgagccgg

SEQ ID NO: 3105 - DNA, 18 bp, synthetic construct
  source 1..18: mol_type = other DNA
ggaggcagcggcggcggc

SEQ ID NO: 3106 - DNA, 240 bp, synthetic construct
  source 1..240: mol_type = other DNA
ggcggcccaagcagcggcgcccctcctcccagcggcggcagcccagccggctccccaacctctaccgaggagggcacctctgagtccgccacccccgagagcggccctggcacctccaccgagcccagcgagggcagcgcacccggcagccctgccggcagccccacctccacagaggagggaaccagcaccgagcccagcgaaggcagcgccccaggcaccagcaccgagcctagtgag

SEQ ID NO: 3107 - DNA, 33 bp, synthetic construct
  source 1..33: mol_type = other DNA
cggtctggcggatctggcggaggctccaccagc

SEQ ID NO: 3108 - DNA, 31 bp, synthetic construct
  source 1..31: mol_type = other DNA
cccaagaaaaagagaaaagtctaatagataa

SEQ ID NO: 3109 - RNA, 79 nt, synthetic construct
  source 1..79: mol_type = other RNA
aaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3110 - RNA, 20 nt, synthetic construct
  source 1..20: mol_type = other RNA
ggaatgcccgccagcgcgac

SEQ ID NO: 3111 - DNA, 408 bp, synthetic construct
  source 1..408: mol_type = other DNA
atggaacgcctcgtctacgaggtgcggcagaagtgcagaaacatcgaggacatctgcatctcctgcggatctctgaacgtgaccctggagcacccactgttcatcggcggcatgtgccagaactgtaaaaactgttttctggagtgtgcctatcaatacgacgatgacggctaccagagctactgcaccatctgttgcggcggaagagaggtgctgatgtgtggaaataacaactgctgccggtgcttctgcgtggaatgcgtggacctgctggtgggccccggcgccgcccaggccgctattaaggaagatccttggaactgctacatgtgcggccacaagggcacatacggcctgctgagacggagagaggactggcctagcagactgcagatgttcttcgccaat

SEQ ID NO: 3112 - DNA, 903 bp, synthetic construct
  source 1..903: mol_type = other DNA
aaccacgaccaggagttcgacccccctaaggtgtaccctcccgtccccgccgagaagagaaagcccatccgggtcctgagcctgttcgatggcatcgccaccggtctgctggtgctgaaggacctgggcatccaggtggataggtacattgcctccgaggtgtgcgaggactccatcaccgtgggaatggtgcgtcatcagggcaagatcatgtacgtgggcgacgtgcggagcgtgacacagaagcatatccaggagtggggccctttcgacctggtgatcggcggcagcccttgcaatgacctgagcatcgtgaacccagcccggaagggcctgtacgagggaaccggcagactgttcttcgagttttacagactgctgcacgacgcccggcctaaggaaggcgacgaccggcccttcttttggctgttcgagaatgtggtggccatgggagtcagcgacaagcgggatattagccggttcctggagagcaaccccgtgatgatcgatgccaaggaagtgagcgccgcccaccgggccagatacttctggggcaatctgcctggcatgaacagacccctggccagcaccgtgaacgacaagctggagctgcaggagtgcctggagcacggccggatcgccaagttcagcaaggtgagaaccatcaccacccgaagcaacagcatcaaacaaggcaaggaccagcactttcctgtgttcatgaacgagaaggaggacatcctgtggtgtaccgagatggagagagtgttcgggttcccagtccactacacagatgtcagcaacatgtctagactggccagacagagactgctgggaagaagctggtccgtccctgtgatcagacacctgttcgcccctctgaaggagtacttcgcctgcgtg

SEQ ID NO: 3113 - RNA, 20 nt, synthetic construct
  source 1..20: mol_type = other RNA
taaacatcacgagactctaa

SEQ ID NO: 3114 - RNA, 20 nt, synthetic construct
  source 1..20: mol_type = other RNA
tccctatgtccttgctgttt

SEQ ID NO: 3115 - RNA, 44 nt, synthetic construct
  source 1..44: mol_type = other RNA
aaataagagagaaaagaagagtaagaagaaatataagagccacc

SEQ ID NO: 3116 - RNA, 33 nt, synthetic construct
  source 1..33: mol_type = other RNA
atggcccctaagaagaagcgtaaagtgagccgg

SEQ ID NO: 3117 - RNA, 906 nt, synthetic construct
  source 1..906: mol_type = other RNA
atgaaccacgaccaggagttcgacccccctaaggtgtaccctcccgtccccgccgagaagagaaagcccatccgggtcctgagcctgttcgatggcatcgccaccggtctgctggtgctgaaggacctgggcatccaggtggataggtacattgcctccgaggtgtgcgaggactccatcaccgtgggaatggtgcgtcatcagggcaagatcatgtacgtgggcgacgtgcggagcgtgacacagaagcatatccaggagtggggccctttcgacctggtgatcggcggcagcccttgcaatgacctgagcatcgtgaacccagcccggaagggcctgtacgagggaaccggcagactgttcttcgagttttacagactgctgcacgacgcccggcctaaggaaggcgacgaccggcccttcttttggctgttcgagaatgtggtggccatgggagtcagcgacaagcgggatattagccggttcctggagagcaaccccgtgatgatcgatgccaaggaagtgagcgccgcccaccgggccagatacttctggggcaatctgcctggcatgaacagacccctggccagcaccgtgaacgacaagctggagctgcaggagtgcctggagcacggccggatcgccaagttcagcaaggtgagaaccatcaccacccgaagcaacagcatcaaacaaggcaaggaccagcactttcctgtgttcatgaacgagaaggaggacatcctgtggtgtaccgagatggagagagtgttcgggttcccagtccactacacagatgtcagcaacatgtctagactggccagacagagactgctgggaagaagctggtccgtccctgtgatcagacacctgttcgcccctctgaaggagtacttcgcctgcgtg

SEQ ID NO: 3118 - RNA, 81 nt, synthetic construct
  source 1..81: mol_type = other RNA
agcagcggcaacagcaacgccaacagccggggccccagcttctctagcggcctggtgccactgtccctgagagggagccac

SEQ ID NO: 3119 - RNA, 645 nt, synthetic construct
  source 1..645: mol_type = other RNA
atgggccccatggagatctacaaaaccgtgagcgcctggaagcggcagcctgtgcgcgtgctgagcctgtttcggaatatcgataaagtcctgaaaagcctgggattcctggagagcggctctggctccggcggtggcaccctgaagtacgtggaggatgtgacaaacgtggtcagacgggatgtggagaagtggggccccttcgatctggtgtacggcagcacccaacccctgggcagctcttgtgaccggtgccctggctggtacatgtttcagttccaccggatcctgcagtacgccctgccgagacaggagtcccagcggccattcttttggattttcatggacaacttgctgctgaccgaggatgaccaggaaactaccactcggttcctgcagaccgaagccgtgaccctgcaggacgtgagaggccgggactaccagaacgccatgcgggtgtggtccaacatccctggactgaaaagcaagcacgcacctctgacccctaaagaagaggagtacctgcaggcccaggtgcggagcagaagcaagctggacgcccctaaggtggatctgctggtgaagaattgcctcctgcccctgagagagtacttcaagtatttcagccagaatagtctgcccctg

SEQ ID NO: 3120 - RNA, 300 nt, synthetic construct
  source 1..300: mol_type = other RNA
atgaacaactcccagggcagagtgaccttcgaggacgtgaccgtgaattttacacagggagagtggcagagactgaaccccgagcagagaaacctgtaccgggatgtgatgctggaaaactacagcaatctggtgtccgtgggccagggcgagaccacaaagcctgacgtgatcctgcgtctggagcagggcaaggaaccctggctggaggaggaggaggtgctgggaagcggacgggccgagaagaacggcgacatcggcggacagatctggaagcctaaggacgtgaaagaaagcctg

SEQ ID NO: 3121 - RNA, 240 nt, synthetic construct
  source 1..240: mol_type = other RNA
ggcggcccaagcagcggcgcccctcctcccagcggcggcagcccagccggctccccaacctctaccgaggagggcacctctgagtccgccacccccgagagcggccctggcacctccaccgagcccagcgagggcagcgcacccggcagccctgccggcagccccacctccacagaggagggaaccagcaccgagcccagcgaaggcagcgccccaggcaccagcaccgagcctagtgag

SEQ ID NO: 3122 - RNA, 2931 nt, synthetic construct
  source 1..2931: mol_type = other RNA
caggagattaaacggatcaacaagatcagaagaagacttgtgaaagacagcaacaccaagaaggccggcaagacaggccccatgaaaaccctgctggttagagtgatgacacccgatctgagagagcggctggaaaacctgagaaagaagcctgaaaatatcccccagcccatcagcaatacatctagagccaacctgaataagctgctgaccgattacaccgaaatgaagaaggcgatcctgcatgtgtactgggaagagttccagaaggaccctgtgggcctgatgagccgggtggcccagcctgccagcaagaagatcgatcagaacaagctgaaacctgagatggacgagaagggcaacctgaccaccgccggctttgcctgctctcagtgtggccagcccctgttcgtgtacaagctggagcaggtgtctgagaagggcaaggcttacaccaactacttcggacggtgcaatgtggccgagcacgaaaagctgatcctgctggcccagctgaagcccgagaaggatagcgacgaagccgtgacatatagcctgggaaagtttgggcagagggccctggatttctacagcattcatgtgaccaaggagtccacccaccccgtgaagcccctggcccagatcgccggaaacagatacgcctccggacctgtgggaaaggccctgagcgacgcatgtatgggcacaatcgcctccttcctgtctaagtaccaggacatcatcatcgaacaccagaaggtggtgaagggcaaccagaagagactggagagcctgcgggagctggccggcaaggaaaacctggaataccctagcgtgaccctgccacctcagcctcacaccaaggagggcgttgatgcctacaacgaagtgatcgcccgggtgcgaatgtgggtgaacctgaacctgtggcagaagctgaagctaagcagagatgatgccaagcctctgctgagactgaagggattcccttcctttcctctggtcgagagacaggccaacgaagtggactggtgggacatggtgtgtaacgtgaagaagctgatcaacgagaaaaaggaggatggcaaggtgttttggcagaatctggctggctacaagagacaggaagccctgagaccatacctgagcagcgaggaagatcggaagaagggaaagaaattcgctcggtaccagctgggcgacctgctgctgcacctggaaaagaagcacggcgaggactggggaaaggtgtacgacgaggcctgggagcggattgacaagaaagtggaaggcctgagcaagcacatcaagctggaagaggaacggagaagcgaggacgcccagagcaaggccgccctgaccgactggctgcgggctaaggccagcttcgtgatcgagggcctgaaggaggccgacaaggacgagttctgcagatgcgagctgaagctgcagaagtggtacggggacctgcggggaaagcccttcgccatcgaagccgagaacagcatcctggacatcagcggcttcagcaagcagtacaactgtgccttcatctggcagaaggacggcgtgaagaagctgaacctgtacctgatcatcaactacttcaagggcggcaagctgcggttcaagaagatcaaacctgaagccttcgaagccaacagattctacaccgtgatcaacaaaaagagcggcgagatcgtgcccatggaggtgaacttcaacttcgacgaccccaacctgatcatcctgcctctggcctttggcaagagacagggcagagaattcatctggaacgacctgctgtccctggaaaccggcagcctgaagctggccaacggaagagtgatcgagaagacactgtacaacagaagaacccggcaggatgagcctgccctgttcgtggccctgaccttcgagcggcgggaggtcctggactcctccaatatcaaaccaatgaacctgatcggcgtggcaagaggcgaaaacatccccgccgtgatcgccctgaccgaccccgagggctgcccactgagccggtttaaggatagcctgggaaacccaacccacatcctgagaatcggcgagagctataaggagaagcagcggaccatccaggccaagaaggaggtggagcagcggagagccggcggctacagccggaagtacgccagcaaagccaagaatctggcagacgatatggtgagaaacaccgctagagatctgctgtactacgccgtgacccaggatgccatgctgatcttcgccaacctgagccggggcttcggccggcagggcaagcggaccttcatggccgagagacagtacacacggatggaggactggctgaccgccaagctggcctacgagggcctgagcaagacctacctgtccaagacactggcccagtacacctccaagacatgcagcaactgtgggtttaccatcaccagcgccgactacgacagggtgctggagaagctgaagaagacagcaacaggctggatgaccacaattaacggcaaggagctgaaggtggagggccagattacctactacaacagatacaagagacagaacgtagtcaaggacctgtccgtcgagctggatagactgagcgaagaatctgtgaacaacgacatctcctcctggacaaagggcagaagcggagaagctctgagcctcctgaagaaaagattctcccatagacccgtgcaggagaagttcgtgtgcctgaactgcggcttcgagacacacgcagccgagcaagccgccctgaacatcgccagatcctggctgttcctgcggagccaggagtacaagaaataccagacaaacaagacaaccggcaacaccgataagagagccttcgtcgagacctggcagtccttttaccggaagaagcttaaggaggtgtggaaacctgccgtg

SEQ ID NO: 3123 - RNA, 33 nt, synthetic construct
  source 1..33: mol_type = other RNA
cggtctggcggatctggcggaggctccaccagc

SEQ ID NO: 3124 - RNA, 31 nt, synthetic construct
  source 1..31: mol_type = other RNA
cccaagaaaaagagaaaagtctaatagataa

SEQ ID NO: 3125 - RNA, 93 nt, synthetic construct
  source 1..93: mol_type = other RNA
gctgccttctgcggggcttgccttctggccatgcccttcttctctcccttgcacctgtacctcttggtctttgaataaagcctgagtaggaag

SEQ ID NO: 3126 - skipped

SEQ ID NO: 3127 - RNA, 408 nt, synthetic construct
  source 1..408: mol_type = other RNA
atggaacgcctcgtctacgaggtgcggcagaagtgcagaaacatcgaggacatctgcatctcctgcggatctctgaacgtgaccctggagcacccactgttcatcggcggcatgtgccagaactgtaaaaactgttttctggagtgtgcctatcaatacgacgatgacggctaccagagctactgcaccatctgttgcggcggaagagaggtgctgatgtgtggaaataacaactgctgccggtgcttctgcgtggaatgcgtggacctgctggtgggccccggcgccgcccaggccgctattaaggaagatccttggaactgctacatgtgcggccacaagggcacatacggcctgctgagacggagagaggactggcctagcagactgcagatgttcttcgccaat

SEQ ID NO: 3128 - RNA, 903 nt, synthetic construct
  source 1..903: mol_type = other RNA
aaccacgaccaggagttcgacccccctaaggtgtaccctcccgtccccgccgagaagagaaagcccatccgggtcctgagcctgttcgatggcatcgccaccggtctgctggtgctgaaggacctgggcatccaggtggataggtacattgcctccgaggtgtgcgaggactccatcaccgtgggaatggtgcgtcatcagggcaagatcatgtacgtgggcgacgtgcggagcgtgacacagaagcatatccaggagtggggccctttcgacctggtgatcggcggcagcccttgcaatgacctgagcatcgtgaacccagcccggaagggcctgtacgagggaaccggcagactgttcttcgagttttacagactgctgcacgacgcccggcctaaggaaggcgacgaccggcccttcttttggctgttcgagaatgtggtggccatgggagtcagcgacaagcgggatattagccggttcctggagagcaaccccgtgatgatcgatgccaaggaagtgagcgccgcccaccgggccagatacttctggggcaatctgcctggcatgaacagacccctggccagcaccgtgaacgacaagctggagctgcaggagtgcctggagcacggccggatcgccaagttcagcaaggtgagaaccatcaccacccgaagcaacagcatcaaacaaggcaaggaccagcactttcctgtgttcatgaacgagaaggaggacatcctgtggtgtaccgagatggagagagtgttcgggttcccagtccactacacagatgtcagcaacatgtctagactggccagacagagactgctgggaagaagctggtccgtccctgtgatcagacacctgttcgcccctctgaaggagtacttcgcctgcgtg

SEQ ID NO: 3129 - RNA, 5439 nt, synthetic construct
  source 1..5439: mol_type = other RNA
  modified_base order(4,22,32,34,46,53,65,70,79,96,97,107,112,114,119,124,148,154,157,163,165,166,170,175,185,187,190,193,196,205,211,217,221,225,229,230,234,241,243,252,256,262,268,271,275,278,289,292,294,298,307,316,329,331,339,347,348,349,355,358,361,374,375,380,385,391,394,415,417,436,438,439,441,442,447,448,449,450,457,460,476,498,499,501,502,503,504,508,510,511,518,520,523,529,535,551,553,554,561,562,565,580,583,586,590,601,624,627,628,630,638,640,644,649,661,673,685,691,699,703,718,726,727,736,745,766,789,790,791,794,796,798,799,802,820,823,825,828,830,838,847,849,850,855,856,862,867,875,877,886,888,890,895,910,913,924,927,931,935,937,940,949,951,952,959,961,969,972,973,978,982,1023,1024,1026,1028,1036,1039,1045,1047,1051,1066,1075,1081,1083,1093,1101,1115,1117,1123,1126,1132,1134,1135,1136,1142,1144,1148,1153,1156,1165,1170,1171,1174,1185,1187,1191,1199,1207,1212,1216,1223,1225,1234,1237,1247,1249,1257,1266,1267,1271,1273,1276,1278,1297,1305,1307,1308,1310,1317,1322,1326,1329,1333,1335,1336,1337,1341,1342,1351,1354,1359,1366,1380,1392,1393,1395,1396,1397,1398,1402,1403,1404,1405,1408,1416,1417,1420,1423,1433,1445,1451,1455,1456,1459,1474,1480,1489,1503,1516,1522,1524,1527,1534,1538,1543,1562,1564,1571,1584,1588,1600,1618,1628,1633,1637,1639,1642,1645,1652,1653,1657,1660,1666,1674,1677,1678,1683,1685,1686,1687,1697,1700,1702,1708,1729,1737,1750,1755,1756,1765,1771,1775,1776,1777,1778,1791,1801,1822,1824,1832,1834,1837,1840,1848,1856,1858,1861,1863,1867,1892,1897,1900,1903,1907,1909,1929,1933,1948,1951,1984,1996,1998,2006,2014,2026,2051,2054,2079,2088,2090,2106,2108,2112,2135,2142,2180,2196,2261,2264,2275,2276,2284,2293,2305,2306,2308,2350,2359,2362,2365,2366,2371,2374,2384,2386,2398,2407,2420,2426,2428,2440,2447,2451,2453,2464,2468,2473,2476,2483,2484,2494,2506,2509,2513,2515,2517,2520,2529,2530,2543,2545,2551,2554,2563,2573,2587,2591,2602,2609,2614,2632,2646,2647,2648,2652,2655,2657,2661,2663,2674,2676,2677,2680,2682,2689,2698,2700,2702,2717,2718,2727,2730,2731,2739,2744,2746,2764,2767,2770,2773,2782,2798,2812,2817,2819,2824,2832,2833,2834,2848,2852,2853,2854,2856,2863,2864,2867,2869,2880,2893,2902,2911,2925,2931,2939,2941,2953,2964,2966,2968,2977,2982,2985,2986,2989,2991,2993,2997,3007,3010,3013,3028,3031,3052,3061,3070,3088,3093,3098,3103,3109,3116,3122,3139,3140,3143,3147,3157,3160,3169,3175,3177,3181,3187,3193,3195,3205,3211,3221,3224,3233,3235,3238,3244,3252,3253,3257,3258,3261,3262,3263,3266,3268,3271,3292,3297,3300,3307,3310,3312,3314,3319,3328,3331,3350,3358,3360,3361,3362,3363,3371,3373,3377,3381,3400,3408,3412,3428,3447,3448,3452,3456,3463,3472,3475,3478,3484,3507,3517,3519,3531,3541,3542,3553,3562,3574,3580,3625,3633,3637,3644,3654,3655,3658,3661,3670,3693,3694,3696,3702,3709,3715,3723,3726,3736,3750,3751,3757,3775,3778,3784,3792,3793,3804,3810,3812,3816,3817,3820,3822,3838,3847,3853,3855,3859,3862,3865,3870,3873,3874,3889,3894,3895,3904,3911,3918,3919,3933,3934,3936,3943,3946,3967,3970,3976,3982,3987,3988,3993,3994,4009,4012,4015,4018,4022,4024,4029,4030,4031,4053,4054,4057,4059,4069,4072,4074,4078,4093,4099,4114,4117,4129,4131,4154,4160,4165,4167,4168,4171,4177,4182,4183,4198,4201,4206,4209,4214,4216,4225,4231,4234,4240,4258,4267,4270,4276,4293,4300,4308,4309,4310,4316,4321,4339,4342,4348,4359,4361,4381,4399,4422,4434,4454,4456,4466,4468,4471,4484,4490,4492,4495,4497,4500,4507,4517,4522,4525,4528,4530,4531,4540,4551,4552,4575,4576,4579,4593,4603,4611,4615,4627,4632,4642,4653,4657,4659,4669,4677,4683,4692,4701,4703,4707,4708,4709,4714,4728,4738,4741,4750,4770,4774,4783,4784,4798,4804,4816,4817,4821,4824,4833,4849,4852,4861,4863,4867,4873,4877,4882,4893,4895,4897,4909,4911,4914,4917,4943,4945,4951,4954,4965,4966,4968,4973,4981,4992,4993,4996,4998,5002,5007,5013,5014,5044,5050,5058,5061,5065,5067,5068,5071,5085,5094,5126,5136,5137,5140,5148,5154,5157,5158,5159,5160,5173,5174,5182,5184,5192,5197,5202,5204,5211,5213,5223,5251,5253,5256,5260,5265,5269,5270,5272,5280,5281,5285,5286,5288,5294,5299,5300,5302,5303,5305,5307,5311,5312,5318,5320,5324,5326,5327,5330,5332,5333,5334,5338,5345,5349,5356,5358): mod_base = m1f
aaataagagagaaaagaagagtaagaagaaatataagagccaccatggcccctaagaagaagcgtaaagtgagccggatgaaccacgaccaggagttcgacccccctaaggtgtaccctcccgtccccgccgagaagagaaagcccatccgggtcctgagcctgttcgatggcatcgccaccggtctgctggtgctgaaggacctgggcatccaggtggataggtacattgcctccgaggtgtgcgaggactccatcaccgtgggaatggtgcgtcatcagggcaagatcatgtacgtgggcgacgtgcggagcgtgacacagaagcatatccaggagtggggccctttcgacctggtgatcggcggcagcccttgcaatgacctgagcatcgtgaacccagcccggaagggcctgtacgagggaaccggcagactgttcttcgagttttacagactgctgcacgacgcccggcctaaggaaggcgacgaccggcccttcttttggctgttcgagaatgtggtggccatgggagtcagcgacaagcgggatattagccggttcctggagagcaaccccgtgatgatcgatgccaaggaagtgagcgccgcccaccgggccagatacttctggggcaatctgcctggcatgaacagacccctggccagcaccgtgaacgacaagctggagctgcaggagtgcctggagcacggccggatcgccaagttcagcaaggtgagaaccatcaccacccgaagcaacagcatcaaacaaggcaaggaccagcactttcctgtgttcatgaacgagaaggaggacatcctgtggtgtaccgagatggagagagtgttcgggttcccagtccactacacagatgtcagcaacatgtctagactggccagacagagactgctgggaagaagctggtccgtccctgtgatcagacacctgttcgcccctctgaaggagtacttcgcctgcgtgagcagcggcaacagcaacgccaacagccggggccccagcttctctagcggcctggtgccactgtccctgagagggagccacatgggccccatggagatctacaaaaccgtgagcgcctggaagcggcagcctgtgcgcgtgctgagcctgtttcggaatatcgataaagtcctgaaaagcctgggattcctggagagcggctctggctccggcggtggcaccctgaagtacgtggaggatgtgacaaacgtggtcagacgggatgtggagaagtggggccccttcgatctggtgtacggcagcacccaacccctgggcagctcttgtgaccggtgccctggctggtacatgtttcagttccaccggatcctgcagtacgccctgccgagacaggagtcccagcggccattcttttggattttcatggacaacttgctgctgaccgaggatgaccaggaaactaccactcggttcctgcagaccgaagccgtgaccctgcaggacgtgagaggccgggactaccagaacgccatgcgggtgtggtccaacatccctggactgaaaagcaagcacgcacctctgacccctaaagaagaggagtacctgcaggcccaggtgcggagcagaagcaagctggacgcccctaaggtggatctgctggtgaagaattgcctcctgcccctgagagagtacttcaagtatttcagccagaatagtctgcccctgggaggcagcggcggcggcatgaacaactcccagggcagagtgaccttcgaggacgtgaccgtgaattttacacagggagagtggcagagactgaaccccgagcagagaaacctgtaccgggatgtgatgctggaaaactacagcaatctggtgtccgtgggccagggcgagaccacaaagcctgacgtgatcctgcgtctggagcagggcaaggaaccctggctggaggaggaggaggtgctgggaagcggacgggccgagaagaacggcgacatcggcggacagatctggaagcctaaggacgtgaaagaaagcctgggcggcccaagcagcggcgcccctcctcccagcggcggcagcccagccggctccccaacctctaccgaggagggcacctctgagtccgccacccccgagagcggccctggcacctccaccgagcccagcgagggcagcgcacccggcagccctgccggcagccccacctccacagaggagggaaccagcaccgagcccagcgaaggcagcgccccaggcaccagcaccgagcctagtgagcaggagattaaacggatcaacaagatcagaagaagacttgtgaaagacagcaacaccaagaaggccggcaagacaggccccatgaaaaccctgctggttagagtgatgacacccgatctgagagagcggctggaaaacctgagaaagaagcctgaaaatatcccccagcccatcagcaatacatctagagccaacctgaataagctgctgaccgattacaccgaaatgaagaaggcgatcctgcatgtgtactgggaagagttccagaaggaccctgtgggcctgatgagccgggtggcccagcctgccagcaagaagatcgatcagaacaagctgaaacctgagatggacgagaagggcaacctgaccaccgccggctttgcctgctctcagtgtggccagcccctgttcgtgtacaagctggagcaggtgtctgagaagggcaaggcttacaccaactacttcggacggtgcaatgtggccgagcacgaaaagctgatcctgctggcccagctgaagcccgagaaggatagcgacgaagccgtgacatatagcctgggaaagtttgggcagagggccctggatttctacagcattcatgtgaccaaggagtccacccaccccgtgaagcccctggcccagatcgccggaaacagatacgcctccggacctgtgggaaaggccctgagcgacgcatgtatgggcacaatcgcctccttcctgtctaagtaccaggacatcatcatcgaacaccagaaggtggtgaagggcaaccagaagagactggagagcctgcgggagctggccggcaaggaaaacctggaataccctagcgtgaccctgccacctcagcctcacaccaaggagggcgttgatgcctacaacgaagtgatcgcccgggtgcgaatgtgggtgaacctgaacctgtggcagaagctgaagctaagcagagatgatgccaagcctctgctgagactgaagggattcccttcctttcctctggtcgagagacaggccaacgaagtggactggtgggacatggtgtgtaacgtgaagaagctgatcaacgagaaaaaggaggatggcaaggtgttttggcagaatctggctggctacaagagacaggaagccctgagaccatacctgagcagcgaggaagatcggaagaagggaaagaaattcgctcggtaccagctgggcgacctgctgctgcacctggaaaagaagcacggcgaggactggggaaaggtgtacgacgaggcctgggagcggattgacaagaaagtggaaggcctgagcaagcacatcaagctggaagaggaacggagaagcgaggacgcccagagcaaggccgccctgaccgactggctgcgggctaaggccagcttcgtgatcgagggcctgaaggaggccgacaaggacgagttctgcagatgcgagctgaagctgcagaagtggtacggggacctgcggggaaagcccttcgccatcgaagccgagaacagcatcctggacatcagcggcttcagcaagcagtacaactgtgccttcatctggcagaaggacggcgtgaagaagctgaacctgtacctgatcatcaactacttcaagggcggcaagctgcggttcaagaagatcaaacctgaagccttcgaagccaacagattctacaccgtgatcaacaaaaagagcggcgagatcgtgcccatggaggtgaacttcaacttcgacgaccccaacctgatcatcctgcctctggcctttggcaagagacagggcagagaattcatctggaacgacctgctgtccctggaaaccggcagcctgaagctggccaacggaagagtgatcgagaagacactgtacaacagaagaacccggcaggatgagcctgccctgttcgtggccctgaccttcgagcggcgggaggtcctggactcctccaatatcaaaccaatgaacctgatcggcgtggcaagaggcgaaaacatccccgccgtgatcgccctgaccgaccccgagggctgcccactgagccggtttaaggatagcctgggaaacccaacccacatcctgagaatcggcgagagctataaggagaagcagcggaccatccaggccaagaaggaggtggagcagcggagagccggcggctacagccggaagtacgccagcaaagccaagaatctggcagacgatatggtgagaaacaccgctagagatctgctgtactacgccgtgacccaggatgccatgctgatcttcgccaacctgagccggggcttcggccggcagggcaagcggaccttcatggccgagagacagtacacacggatggaggactggctgaccgccaagctggcctacgagggcctgagcaagacctacctgtccaagacactggcccagtacacctccaagacatgcagcaactgtgggtttaccatcaccagcgccgactacgacagggtgctggagaagctgaagaagacagcaacaggctggatgaccacaattaacggcaaggagctgaaggtggagggccagattacctactacaacagatacaagagacagaacgtagtcaaggacctgtccgtcgagctggatagactgagcgaagaatctgtgaacaacgacatctcctcctggacaaagggcagaagcggagaagctctgagcctcctgaagaaaagattctcccatagacccgtgcaggagaagttcgtgtgcctgaactgcggcttcgagacacacgcagccgagcaagccgccctgaacatcgccagatcctggctgttcctgcggagccaggagtacaagaaataccagacaaacaagacaaccggcaacaccgataagagagccttcgtcgagacctggcagtccttttaccggaagaagcttaaggaggtgtggaaacctgccgtgcggtctggcggatctggcggaggctccaccagccccaagaaaaagagaaaagtctaatagataagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3130 - RNA, 5844 nt, synthetic construct
  source 1..5844: mol_type = other RNA
  modified_base order(4,22,32,34,46,53,65,70,79,88,91,93,100,111,121,130,132,136,138,141,147,149,151,157,163,175,177,178,181,190,192,201,203,210,212,213,214,215,217,222,224,228,230,234,242,249,258,261,268,270,272,273,289,292,295,297,299,305,312,315,321,324,325,327,331,336,340,346,349,352,377,379,380,389,392,393,399,402,406,408,426,433,436,453,458,466,472,474,475,477,478,485,501,502,512,517,519,524,529,553,559,562,568,570,571,575,580,590,592,595,598,601,610,616,622,626,630,634,635,639,646,648,657,661,667,673,676,680,683,694,697,699,703,712,721,734,736,744,752,753,754,760,763,766,779,780,785,790,796,799,820,822,841,843,844,846,847,852,853,854,855,862,865,881,903,904,906,907,908,909,913,915,916,923,925,928,934,940,956,958,959,966,967,970,985,988,991,995,1006,1029,1032,1033,1035,1043,1045,1049,1054,1066,1078,1090,1096,1104,1108,1123,1131,1132,1141,1150,1171,1194,1195,1196,1199,1201,1203,1204,1207,1225,1228,1230,1233,1235,1243,1252,1254,1255,1260,1261,1267,1272,1280,1282,1291,1293,1295,1300,1315,1318,1329,1332,1336,1340,1342,1345,1354,1356,1357,1364,1366,1374,1377,1378,1383,1387,1428,1429,1431,1433,1441,1444,1450,1452,1456,1471,1480,1486,1488,1498,1506,1520,1522,1528,1531,1537,1539,1540,1541,1547,1549,1553,1558,1561,1570,1575,1576,1579,1590,1592,1596,1604,1612,1617,1621,1628,1630,1639,1642,1652,1654,1662,1671,1672,1676,1678,1681,1683,1702,1710,1712,1713,1715,1722,1727,1731,1734,1738,1740,1741,1742,1746,1747,1756,1759,1764,1771,1785,1797,1798,1800,1801,1802,1803,1807,1808,1809,1810,1813,1821,1822,1825,1828,1838,1850,1856,1860,1861,1864,1879,1885,1894,1908,1921,1927,1929,1932,1939,1943,1948,1967,1969,1976,1989,1993,2005,2023,2033,2038,2042,2044,2047,2050,2057,2058,2062,2065,2071,2079,2082,2083,2088,2090,2091,2092,2102,2105,2107,2113,2134,2142,2155,2160,2161,2170,2176,2180,2181,2182,2183,2196,2206,2227,2229,2237,2239,2242,2245,2253,2261,2263,2266,2268,2272,2297,2302,2305,2308,2312,2314,2334,2338,2353,2356,2389,2401,2403,2411,2419,2431,2456,2459,2484,2493,2495,2511,2513,2517,2540,2547,2585,2601,2666,2669,2680,2681,2689,2698,2710,2711,2713,2755,2764,2767,2770,2771,2776,2779,2789,2791,2803,2812,2825,2831,2833,2845,2852,2856,2858,2869,2873,2878,2881,2888,2889,2899,2911,2914,2918,2920,2922,2925,2934,2935,2948,2950,2956,2959,2968,2978,2992,2996,3007,3014,3019,3037,3051,3052,3053,3057,3060,3062,3066,3068,3079,3081,3082,3085,3087,3094,3103,3105,3107,3122,3123,3132,3135,3136,3144,3149,3151,3169,3172,3175,3178,3187,3203,3217,3222,3224,3229,3237,3238,3239,3253,3257,3258,3259,3261,3268,3269,3272,3274,3285,3298,3307,3316,3330,3336,3344,3346,3358,3369,3371,3373,3382,3387,3390,3391,3394,3396,3398,3402,3412,3415,3418,3433,3436,3457,3466,3475,3493,3498,3503,3508,3514,3521,3527,3544,3545,3548,3552,3562,3565,3574,3580,3582,3586,3592,3598,3600,3610,3616,3626,3629,3638,3640,3643,3649,3657,3658,3662,3663,3666,3667,3668,3671,3673,3676,3697,3702,3705,3712,3715,3717,3719,3724,3733,3736,3755,3763,3765,3766,3767,3768,3776,3778,3782,3786,3805,3813,3817,3833,3852,3853,3857,3861,3868,3877,3880,3883,3889,3912,3922,3924,3936,3946,3947,3958,3967,3979,3985,4030,4038,4042,4049,4059,4060,4063,4066,4075,4098,4099,4101,4107,4114,4120,4128,4131,4141,4155,4156,4162,4180,4183,4189,4197,4198,4209,4215,4217,4221,4222,4225,4227,4243,4252,4258,4260,4264,4267,4270,4275,4278,4279,4294,4299,4300,4309,4316,4323,4324,4338,4339,4341,4348,4351,4372,4375,4381,4387,4392,4393,4398,4399,4414,4417,4420,4423,4427,4429,4434,4435,4436,4458,4459,4462,4464,4474,4477,4479,4483,4498,4504,4519,4522,4534,4536,4559,4565,4570,4572,4573,4576,4582,4587,4588,4603,4606,4611,4614,4619,4621,4630,4636,4639,4645,4663,4672,4675,4681,4698,4705,4713,4714,4715,4721,4726,4744,4747,4753,4764,4766,4786,4804,4827,4839,4859,4861,4871,4873,4876,4889,4895,4897,4900,4902,4905,4912,4922,4927,4930,4933,4935,4936,4945,4956,4957,4980,4981,4984,4998,5008,5016,5020,5032,5037,5047,5058,5062,5064,5074,5082,5088,5097,5106,5108,5112,5113,5114,5119,5133,5143,5146,5155,5175,5179,5188,5189,5203,5209,5221,5222,5226,5229,5238,5254,5257,5266,5268,5272,5278,5282,5287,5298,5300,5302,5314,5316,5319,5322,5348,5350,5356,5359,5370,5371,5373,5378,5386,5397,5398,5401,5403,5407,5412,5418,5419,5449,5455,5463,5466,5470,5472,5473,5476,5490,5499,5531,5541,5542,5545,5553,5559,5562,5563,5564,5565,5578,5579,5587,5589,5597,5602,5607,5609,5616,5618,5628,5656,5658,5661,5665,5670,5674,5675,5677,5685,5686,5690,5691,5693,5699,5704,5705,5707,5708,5710,5712,5716,5717,5723,5725,5729,5731,5732,5735,5737,5738,5739,5743,5750,5754,5761,5763): mod_base = m1f
aaataagagagaaaagaagagtaagaagaaatataagagccaccatggcccctaagaagaagcgtaaagtgagccggatggaacgcctcgtctacgaggtgcggcagaagtgcagaaacatcgaggacatctgcatctcctgcggatctctgaacgtgaccctggagcacccactgttcatcggcggcatgtgccagaactgtaaaaactgttttctggagtgtgcctatcaatacgacgatgacggctaccagagctactgcaccatctgttgcggcggaagagaggtgctgatgtgtggaaataacaactgctgccggtgcttctgcgtggaatgcgtggacctgctggtgggccccggcgccgcccaggccgctattaaggaagatccttggaactgctacatgtgcggccacaagggcacatacggcctgctgagacggagagaggactggcctagcagactgcagatgttcttcgccaataaccacgaccaggagttcgacccccctaaggtgtaccctcccgtccccgccgagaagagaaagcccatccgggtcctgagcctgttcgatggcatcgccaccggtctgctggtgctgaaggacctgggcatccaggtggataggtacattgcctccgaggtgtgcgaggactccatcaccgtgggaatggtgcgtcatcagggcaagatcatgtacgtgggcgacgtgcggagcgtgacacagaagcatatccaggagtggggccctttcgacctggtgatcggcggcagcccttgcaatgacctgagcatcgtgaacccagcccggaagggcctgtacgagggaaccggcagactgttcttcgagttttacagactgctgcacgacgcccggcctaaggaaggcgacgaccggcccttcttttggctgttcgagaatgtggtggccatgggagtcagcgacaagcgggatattagccggttcctggagagcaaccccgtgatgatcgatgccaaggaagtgagcgccgcccaccgggccagatacttctggggcaatctgcctggcatgaacagacccctggccagcaccgtgaacgacaagctggagctgcaggagtgcctggagcacggccggatcgccaagttcagcaaggtgagaaccatcaccacccgaagcaacagcatcaaacaaggcaaggaccagcactttcctgtgttcatgaacgagaaggaggacatcctgtggtgtaccgagatggagagagtgttcgggttcccagtccactacacagatgtcagcaacatgtctagactggccagacagagactgctgggaagaagctggtccgtccctgtgatcagacacctgttcgcccctctgaaggagtacttcgcctgcgtgagcagcggcaacagcaacgccaacagccggggccccagcttctctagcggcctggtgccactgtccctgagagggagccacatgggccccatggagatctacaaaaccgtgagcgcctggaagcggcagcctgtgcgcgtgctgagcctgtttcggaatatcgataaagtcctgaaaagcctgggattcctggagagcggctctggctccggcggtggcaccctgaagtacgtggaggatgtgacaaacgtggtcagacgggatgtggagaagtggggccccttcgatctggtgtacggcagcacccaacccctgggcagctcttgtgaccggtgccctggctggtacatgtttcagttccaccggatcctgcagtacgccctgccgagacaggagtcccagcggccattcttttggattttcatggacaacttgctgctgaccgaggatgaccaggaaactaccactcggttcctgcagaccgaagccgtgaccctgcaggacgtgagaggccgggactaccagaacgccatgcgggtgtggtccaacatccctggactgaaaagcaagcacgcacctctgacccctaaagaagaggagtacctgcaggcccaggtgcggagcagaagcaagctggacgcccctaaggtggatctgctggtgaagaattgcctcctgcccctgagagagtacttcaagtatttcagccagaatagtctgcccctgggaggcagcggcggcggcatgaacaactcccagggcagagtgaccttcgaggacgtgaccgtgaattttacacagggagagtggcagagactgaaccccgagcagagaaacctgtaccgggatgtgatgctggaaaactacagcaatctggtgtccgtgggccagggcgagaccacaaagcctgacgtgatcctgcgtctggagcagggcaaggaaccctggctggaggaggaggaggtgctgggaagcggacgggccgagaagaacggcgacatcggcggacagatctggaagcctaaggacgtgaaagaaagcctgggcggcccaagcagcggcgcccctcctcccagcggcggcagcccagccggctccccaacctctaccgaggagggcacctctgagtccgccacccccgagagcggccctggcacctccaccgagcccagcgagggcagcgcacccggcagccctgccggcagccccacctccacagaggagggaaccagcaccgagcccagcgaaggcagcgccccaggcaccagcaccgagcctagtgagcaggagattaaacggatcaacaagatcagaagaagacttgtgaaagacagcaacaccaagaaggccggcaagacaggccccatgaaaaccctgctggttagagtgatgacacccgatctgagagagcggctggaaaacctgagaaagaagcctgaaaatatcccccagcccatcagcaatacatctagagccaacctgaataagctgctgaccgattacaccgaaatgaagaaggcgatcctgcatgtgtactgggaagagttccagaaggaccctgtgggcctgatgagccgggtggcccagcctgccagcaagaagatcgatcagaacaagctgaaacctgagatggacgagaagggcaacctgaccaccgccggctttgcctgctctcagtgtggccagcccctgttcgtgtacaagctggagcaggtgtctgagaagggcaaggcttacaccaactacttcggacggtgcaatgtggccgagcacgaaaagctgatcctgctggcccagctgaagcccgagaaggatagcgacgaagccgtgacatatagcctgggaaagtttgggcagagggccctggatttctacagcattcatgtgaccaaggagtccacccaccccgtgaagcccctggcccagatcgccggaaacagatacgcctccggacctgtgggaaaggccctgagcgacgcatgtatgggcacaatcgcctccttcctgtctaagtaccaggacatcatcatcgaacaccagaaggtggtgaagggcaaccagaagagactggagagcctgcgggagctggccggcaaggaaaacctggaataccctagcgtgaccctgccacctcagcctcacaccaaggagggcgttgatgcctacaacgaagtgatcgcccgggtgcgaatgtgggtgaacctgaacctgtggcagaagctgaagctaagcagagatgatgccaagcctctgctgagactgaagggattcccttcctttcctctggtcgagagacaggccaacgaagtggactggtgggacatggtgtgtaacgtgaagaagctgatcaacgagaaaaaggaggatggcaaggtgttttggcagaatctggctggctacaagagacaggaagccctgagaccatacctgagcagcgaggaagatcggaagaagggaaagaaattcgctcggtaccagctgggcgacctgctgctgcacctggaaaagaagcacggcgaggactggggaaaggtgtacgacgaggcctgggagcggattgacaagaaagtggaaggcctgagcaagcacatcaagctggaagaggaacggagaagcgaggacgcccagagcaaggccgccctgaccgactggctgcgggctaaggccagcttcgtgatcgagggcctgaaggaggccgacaaggacgagttctgcagatgcgagctgaagctgcagaagtggtacggggacctgcggggaaagcccttcgccatcgaagccgagaacagcatcctggacatcagcggcttcagcaagcagtacaactgtgccttcatctggcagaaggacggcgtgaagaagctgaacctgtacctgatcatcaactacttcaagggcggcaagctgcggttcaagaagatcaaacctgaagccttcgaagccaacagattctacaccgtgatcaacaaaaagagcggcgagatcgtgcccatggaggtgaacttcaacttcgacgaccccaacctgatcatcctgcctctggcctttggcaagagacagggcagagaattcatctggaacgacctgctgtccctggaaaccggcagcctgaagctggccaacggaagagtgatcgagaagacactgtacaacagaagaacccggcaggatgagcctgccctgttcgtggccctgaccttcgagcggcgggaggtcctggactcctccaatatcaaaccaatgaacctgatcggcgtggcaagaggcgaaaacatccccgccgtgatcgccctgaccgaccccgagggctgcccactgagccggtttaaggatagcctgggaaacccaacccacatcctgagaatcggcgagagctataaggagaagcagcggaccatccaggccaagaaggaggtggagcagcggagagccggcggctacagccggaagtacgccagcaaagccaagaatctggcagacgatatggtgagaaacaccgctagagatctgctgtactacgccgtgacccaggatgccatgctgatcttcgccaacctgagccggggcttcggccggcagggcaagcggaccttcatggccgagagacagtacacacggatggaggactggctgaccgccaagctggcctacgagggcctgagcaagacctacctgtccaagacactggcccagtacacctccaagacatgcagcaactgtgggtttaccatcaccagcgccgactacgacagggtgctggagaagctgaagaagacagcaacaggctggatgaccacaattaacggcaaggagctgaaggtggagggccagattacctactacaacagatacaagagacagaacgtagtcaaggacctgtccgtcgagctggatagactgagcgaagaatctgtgaacaacgacatctcctcctggacaaagggcagaagcggagaagctctgagcctcctgaagaaaagattctcccatagacccgtgcaggagaagttcgtgtgcctgaactgcggcttcgagacacacgcagccgagcaagccgccctgaacatcgccagatcctggctgttcctgcggagccaggagtacaagaaataccagacaaacaagacaaccggcaacaccgataagagagccttcgtcgagacctggcagtccttttaccggaagaagcttaaggaggtgtggaaacctgccgtgcggtctggcggatctggcggaggctccaccagccccaagaaaaagagaaaagtctaatagataagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3131 - protein, 1736 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 3132 - protein, 1871 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 3133 - DNA, 39 bp, synthetic construct
  source 1..39: mol_type = other DNA
atggcccctgctgccaagagagtgaagctggatagcaga

SEQ ID NO: 3134 - DNA, 2937 bp, synthetic construct
  source 1..2937: mol_type = other DNA
caggagatcaagcggattaataaaattcggagaagactggtgaaggattctaacacaaagaaggctggcaagacacggggccctatgaagacactgctggtgagagtgatgacacccgacctgagagaaagactggaaaacctgagaaagaagcctgagaatatcccccagcccatcagcaacacaagccgggccaacctgaataagctgctgaccgactacaccgaaatgaagaaggccatcctgcacgtgtattgggaagagttccagaaagacccagtcggcctgatgagcagagtggctcagcctgccagcaagaagatcgatcagaacaagctgaagcccgaaatggacgagaaggggaacctgacaaccgccggctttgcctgtagccagtgcggccagcccctgtttgtgtacaaactggaacaggtgagcgaaaagggcaaggcttacacgaattacttcggcagatgcaacgtggccgagcacgagaagctgatcaagctggcccagctgaagcctgagaaggatagcgatgaggcagtgacatattccctgggcaagttcggacagcgggccctggatttttattccattcatgtgaccaaggaatccacccaccccgtcaagcctcttgcccaaattgccggcaacagatacgcctccagccccgtgggcaaggccctgagcgacgcctgtatgggcaccatcgccagcttcctgtctaagtaccaggacattatcatcgagcaccagaaggtggtgaagggcaaccagaagagactggagagcctgcgcgagctggccggcaaggaaaacctggagtatcctagcgtgaccctgcctcctcagcctcatacaaaggagggcgtggatgcctacaacgaagtgatcgcccgggtgcggatgtgggtgaacctgaatctgtggcagaagctgaagctgtctagagacgacgccaagcccctgctgagactgaagggcttccccagcttccctctggtggagagacaggcaaatgaagtggactggtgggacatggtgtgtaacgtgaagaagctgatcaatgagaagaaggaggacggcaaagtgttctggcagaatctggccggctacaagcgtcaggaggccctgcggccctacctgagcagcgaggaagacagaaagaagggcaagaagttcgcccggtatcagctgggggacctgctgctgcacctcgagaagaagcacggcgaagactgggggaaggtgtacgatgaggcctgggagcggatcgataagaaggtggagggcctgagcaagcacatcaagctggaggaggaacggagatctgaggacgcccagagcaaggccgccctgaccgactggctgagagccaaggccagcttcgtcatcgaggggctgaaggaggccgacaaggacgagttctgccggtgcgaactgaagctgcagaagtggtacggagatctgagaggcaaacctttcgccatcgaggccgagaacagcatcctggacatcagcggcttcagcaagcagtacaactgcgcctttatttggcagaaggacggagtgaagaagctgaacctgtacctgatcatcaactatttcaagggcggcaagctgagattcaagaagatcaagcctgaagccttcgaggccaacagattctacaccgtgattaacaagaaaagcggagagatcgtgccaatggaagtgaacttcaacttcgacgaccctaacctgatcatcctgcccctggcatttggcaagcggcagggcagagagttcatctggaacgacctgctgtctctggagaccggcagcctgaagctggccaacggcagagtgatcgagaagacactgtacaacagacgaaccagacaagacgagcccgccctgtttgtggccctgaccttcgagagaagagaggtgctggacagcagcaatatcaagcctatgaacctgatcggcgtggaccggggcgagaacatccctgccgtgatcgcccttaccgaccccgagggatgccctctgagccggtttaaagacagcctgggcaaccctacccacatcctgagaattggcgagtcctacaaggagaagcagagaaccatccaggccaagaaggaggtggagcagcggcgggctggcggctactcccggaagtacgccagcaaggccaagaacctggccgacgacatggttagaaataccgccagagacctcctgtactacgctgtgacccaggacgccatgctgatcttcgagaacctgagcagaggcttcggcagacagggcaagagaaccttcatggccgagagacagtacacccggatggaggactggctgaccgccaagctggcctacgagggcctgccctctaagacctacctgtccaagaccttggcacagtacaccagcaagacatgctctaactgcggcttcacaatcacgagcgccgactacgaccgggtgctggagaaactgaagaagaccgccacaggctggatgaccaccattaacggcaaggagctgaaggtggagggccagatcacctactacaacaggtacaaacggcagaacgtggtgaaggacctgagcgtggaactggatagactgagcgaggaaagcgtaaacaatgacatcagcagctggaccaagggccggagcggcgaggccctgagcctgctgaagaagagattctcccacagaccagtgcaggagaagttcgtgtgtctgaactgcggcttcgagacccacgccgacgagcaagccgccctgaacatcgcccggtcttggcttttcctgcggagccaggagtacaagaagtaccagacaaacaagaccacaggcaacacagacaagagagccttcgtcgagacctggcagagcttctacagaaagaagctgaaggaggtgtggaagcctgccgtg

SEQ ID NO: 3135 - DNA, 43 bp, synthetic construct
  source 1..43: mol_type = other DNA
ggaagccccgctgccaagagagtgaagctggactaatagataa

SEQ ID NO: 3136 - RNA, 3241 nt, synthetic construct
  source 1..3241: mol_type = other RNA
  modified_base order(4,22,32,34,46,53,56,67,73,77,91,100,101,104,109,110,121,124,131,132,134,149,167,169,178,181,184,190,193,205,217,226,239,245,247,259,283,287,292,295,303,313,325,328,334,336,338,339,348,349,364,370,373,382,386,392,406,410,421,433,451,465,466,467,471,473,480,493,495,496,497,499,501,508,517,536,537,545,546,549,550,558,565,583,586,592,601,608,617,623,631,636,638,639,643,651,652,667,671,672,673,674,675,677,678,682,683,686,688,699,712,719,721,722,730,731,744,750,760,772,783,785,787,796,804,805,808,810,812,816,826,827,829,832,847,850,871,880,889,907,912,914,917,922,928,932,935,941,944,958,962,966,976,979,988,994,996,1000,1006,1010,1012,1014,1024,1030,1032,1034,1054,1057,1063,1071,1072,1080,1081,1085,1087,1090,1106,1111,1116,1119,1126,1129,1131,1133,1138,1147,1150,1154,1177,1179,1180,1182,1190,1192,1200,1208,1219,1227,1231,1266,1267,1275,1277,1282,1291,1294,1297,1303,1326,1336,1338,1343,1350,1360,1364,1372,1381,1393,1399,1416,1418,1444,1452,1456,1473,1474,1477,1480,1489,1512,1513,1515,1521,1528,1534,1542,1545,1553,1555,1568,1569,1570,1576,1594,1597,1603,1611,1612,1623,1629,1635,1636,1637,1639,1640,1641,1657,1666,1672,1674,1678,1681,1684,1689,1691,1692,1693,1708,1713,1714,1723,1730,1737,1738,1752,1753,1755,1762,1765,1766,1786,1789,1795,1801,1806,1807,1812,1813,1823,1828,1831,1834,1837,1843,1848,1849,1850,1872,1873,1876,1878,1888,1891,1893,1895,1897,1912,1918,1933,1936,1948,1950,1984,1986,1987,1988,1990,1996,2001,2002,2017,2020,2033,2035,2042,2044,2050,2053,2059,2077,2081,2086,2089,2095,2096,2112,2117,2119,2127,2128,2129,2140,2150,2158,2161,2167,2168,2175,2178,2200,2218,2234,2241,2244,2253,2275,2287,2290,2291,2297,2311,2314,2316,2319,2324,2326,2341,2344,2347,2349,2350,2359,2370,2371,2394,2395,2398,2412,2422,2430,2434,2446,2451,2461,2466,2468,2475,2479,2481,2490,2491,2499,2514,2517,2519,2523,2529,2530,2536,2550,2560,2563,2572,2592,2596,2605,2606,2620,2626,2638,2643,2646,2655,2671,2674,2683,2689,2695,2699,2704,2719,2726,2731,2739,2767,2773,2776,2787,2788,2790,2803,2814,2815,2818,2820,2822,2824,2829,2835,2836,2866,2872,2880,2882,2883,2887,2888,2889,2890,2893,2907,2916,2958,2959,2962,2970,2979,2980,2982,2995,3004,3006,3014,3019,3032,3043,3049,3054,3057,3061,3066,3070,3071,3073,3081,3082,3086,3087,3089,3095,3100,3101,3103,3104,3106,3108,3112,3113,3119,3121,3125,3127,3128,3131,3133,3134,3135,3139,3146,3150,3157,3159): mod_base = m1f
aaataagagagaaaagaagagtaagaagaaatataagagccaccatggcccctgctgccaagagagtgaagctggatagcagacaggagatcaagcggattaataaaattcggagaagactggtgaaggattctaacacaaagaaggctggcaagacacggggccctatgaagacactgctggtgagagtgatgacacccgacctgagagaaagactggaaaacctgagaaagaagcctgagaatatcccccagcccatcagcaacacaagccgggccaacctgaataagctgctgaccgactacaccgaaatgaagaaggccatcctgcacgtgtattgggaagagttccagaaagacccagtcggcctgatgagcagagtggctcagcctgccagcaagaagatcgatcagaacaagctgaagcccgaaatggacgagaaggggaacctgacaaccgccggctttgcctgtagccagtgcggccagcccctgtttgtgtacaaactggaacaggtgagcgaaaagggcaaggcttacacgaattacttcggcagatgcaacgtggccgagcacgagaagctgatcaagctggcccagctgaagcctgagaaggatagcgatgaggcagtgacatattccctgggcaagttcggacagcgggccctggatttttattccattcatgtgaccaaggaatccacccaccccgtcaagcctcttgcccaaattgccggcaacagatacgcctccagccccgtgggcaaggccctgagcgacgcctgtatgggcaccatcgccagcttcctgtctaagtaccaggacattatcatcgagcaccagaaggtggtgaagggcaaccagaagagactggagagcctgcgcgagctggccggcaaggaaaacctggagtatcctagcgtgaccctgcctcctcagcctcatacaaaggagggcgtggatgcctacaacgaagtgatcgcccgggtgcggatgtgggtgaacctgaatctgtggcagaagctgaagctgtctagagacgacgccaagcccctgctgagactgaagggcttccccagcttccctctggtggagagacaggcaaatgaagtggactggtgggacatggtgtgtaacgtgaagaagctgatcaatgagaagaaggaggacggcaaagtgttctggcagaatctggccggctacaagcgtcaggaggccctgcggccctacctgagcagcgaggaagacagaaagaagggcaagaagttcgcccggtatcagctgggggacctgctgctgcacctcgagaagaagcacggcgaagactgggggaaggtgtacgatgaggcctgggagcggatcgataagaaggtggagggcctgagcaagcacatcaagctggaggaggaacggagatctgaggacgcccagagcaaggccgccctgaccgactggctgagagccaaggccagcttcgtcatcgaggggctgaaggaggccgacaaggacgagttctgccggtgcgaactgaagctgcagaagtggtacggagatctgagaggcaaacctttcgccatcgaggccgagaacagcatcctggacatcagcggcttcagcaagcagtacaactgcgcctttatttggcagaaggacggagtgaagaagctgaacctgtacctgatcatcaactatttcaagggcggcaagctgagattcaagaagatcaagcctgaagccttcgaggccaacagattctacaccgtgattaacaagaaaagcggagagatcgtgccaatggaagtgaacttcaacttcgacgaccctaacctgatcatcctgcccctggcatttggcaagcggcagggcagagagttcatctggaacgacctgctgtctctggagaccggcagcctgaagctggccaacggcagagtgatcgagaagacactgtacaacagacgaaccagacaagacgagcccgccctgtttgtggccctgaccttcgagagaagagaggtgctggacagcagcaatatcaagcctatgaacctgatcggcgtggaccggggcgagaacatccctgccgtgatcgcccttaccgaccccgagggatgccctctgagccggtttaaagacagcctgggcaaccctacccacatcctgagaattggcgagtcctacaaggagaagcagagaaccatccaggccaagaaggaggtggagcagcggcgggctggcggctactcccggaagtacgccagcaaggccaagaacctggccgacgacatggttagaaataccgccagagacctcctgtactacgctgtgacccaggacgccatgctgatcttcgagaacctgagcagaggcttcggcagacagggcaagagaaccttcatggccgagagacagtacacccggatggaggactggctgaccgccaagctggcctacgagggcctgccctctaagacctacctgtccaagaccttggcacagtacaccagcaagacatgctctaactgcggcttcacaatcacgagcgccgactacgaccgggtgctggagaaactgaagaagaccgccacaggctggatgaccaccattaacggcaaggagctgaaggtggagggccagatcacctactacaacaggtacaaacggcagaacgtggtgaaggacctgagcgtggaactggatagactgagcgaggaaagcgtaaacaatgacatcagcagctggaccaagggccggagcggcgaggccctgagcctgctgaagaagagattctcccacagaccagtgcaggagaagttcgtgtgtctgaactgcggcttcgagacccacgccgacgagcaagccgccctgaacatcgcccggtcttggcttttcctgcggagccaggagtacaagaagtaccagacaaacaagaccacaggcaacacagacaagagagccttcgtcgagacctggcagagcttctacagaaagaagctgaaggaggtgtggaagcctgccgtgggaagccccgctgccaagagagtgaagctggactaatagataagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3137 - RNA, 20 nt, synthetic construct
  source 1..20: mol_type = other RNA
ggccgagatgtctcgctccg

SEQ ID NO: 3138 - DNA, 20 bp, synthetic construct
  source 1..20: mol_type = other DNA
tcctggcttcctggtgaaga

SEQ ID NO: 3139 - DNA, 20 bp, synthetic construct
  source 1..20: mol_type = other DNA
tggcttcctggtgaagatga

SEQ ID NO: 3140 - DNA, 20 bp, synthetic construct
  source 1..20: mol_type = other DNA
acagacaggtaagcacggcc

SEQ ID NO: 3141 - DNA, 20 bp, synthetic construct
  source 1..20: mol_type = other DNA
tcccaggcctggagtttatt

SEQ ID NO: 3142 - DNA, 20 bp, synthetic construct
  source 1..20: mol_type = other DNA
tgatagggctgggccactgc

SEQ ID NO: 3143 - DNA, 20 bp, synthetic construct
  source 1..20: mol_type = other DNA
ctgaggaccagcgggtactg

SEQ ID NO: 3144 - DNA, 20 bp, synthetic construct
  source 1..20: mol_type = other DNA
ccaggagtgggaagcggcgg

SEQ ID NO: 3145 - RNA, 109 nt, synthetic construct; identical to SEQ ID NO: 3074
  source 1..109: mol_type = other RNA

SEQ ID NO: 3146 - RNA, 109 nt, synthetic construct
  source 1..109: mol_type = other RNA
actggcgcttttatctgattactttgagagccatcaccagcgactatgtcgtagtgggtaaagctccctcttcggagggagcatcaaagtggcttcctggtgaagatga

SEQ ID NO: 3147 - RNA, 109 nt, synthetic construct; identical to SEQ ID NO: 3146
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 107: mod_base = um
  modified_base 107..109: mod_base = OTHER; note = linked by phosphorothioate
  modified_base 108: mod_base = gm
  modified_base 109: mod_base = OTHER; note = 2'-O-methyladenosine
  source 1..109: mol_type = other RNA

SEQ ID NO: 3148 - RNA, 109 nt, synthetic construct
  source 1..109: mol_type = other RNA
actggcgcttttatctgattactttgagagccatcaccagcgactatgtcgtagtgggtaaagctccctcttcggagggagcatcaaaggtgtagtacaagagatagaa

SEQ ID NO: 3149 - RNA, 109 nt, synthetic construct; identical to SEQ ID NO: 3148
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 107: mod_base = gm
  modified_base 107..109: mod_base = OTHER; note = linked by phosphorothioate
  modified_base 108: mod_base = OTHER; note = 2'-O-methyladenosine
  modified_base 109: mod_base = OTHER; note = 2'-O-methyladenosine
  source 1..109: mol_type = other RNA

SEQ ID NO: 3150 - RNA, 109 nt, synthetic construct
  source 1..109: mol_type = other RNA
actggcgcttctatctgattactctgagcgccatcaccagcgactatgtcgtagtgggtaaagctccctcttcggagggagcatcagagtcctggcttcctggtgaaga

SEQ ID NO: 3151 - RNA, 109 nt, synthetic construct; identical to SEQ ID NO: 3150
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 107: mod_base = OTHER; note = 2'-O-methyladenosine
  modified_base 107..109: mod_base = OTHER; note = linked by phosphorothioate
  modified_base 108: mod_base = gm
  modified_base 109: mod_base = OTHER; note = 2'-O-methyladenosine
  source 1..109: mol_type = other RNA

SEQ ID NO: 3152 - RNA, 109 nt, synthetic construct
  source 1..109: mol_type = other RNA
actggcgcttctatctgattactctgagcgccatcaccagcgactatgtcgtagtgggtaaagctccctcttcggagggagcatcagagtggcttcctggtgaagatga

SEQ ID NO: 3153 - RNA, 109 nt, synthetic construct; identical to SEQ ID NO: 3152
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 107: mod_base = um
  modified_base 107..109: mod_base = OTHER; note = linked by phosphorothioate
  modified_base 108: mod_base = gm
  modified_base 109: mod_base = OTHER; note = 2'-O-methyladenosine
  source 1..109: mol_type = other RNA

SEQ ID NO: 3154 - RNA, 109 nt, synthetic construct
  source 1..109: mol_type = other RNA
actggcgcttctatctgattactctgagcgccatcaccagcgactatgtcgtagtgggtaaagctccctcttcggagggagcatcagaggtgtagtacaagagatagaa

SEQ ID NO: 3155 - RNA, 109 nt, synthetic construct; identical to SEQ ID NO: 3154
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 107: mod_base = gm
  modified_base 107..109: mod_base = OTHER; note = linked by phosphorothioate
  modified_base 108: mod_base = OTHER; note = 2'-O-methyladenosine
  modified_base 109: mod_base = OTHER; note = 2'-O-methyladenosine
  source 1..109: mol_type = other RNA

SEQ ID NO: 3156 - RNA, 107 nt, synthetic construct
  source 1..107: mol_type = other RNA
actggcgcttttatctgattactttgagagccatcaccagcgactatgtcgtagtgggtaaagctccctcttcggagggagcatcaaagggccgagatgtctcgctc

SEQ ID NO: 3157 - RNA, 107 nt, synthetic construct; identical to SEQ ID NO: 3156
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 105: mod_base = cm
  modified_base 105..107: mod_base = OTHER; note = linked by phosphorothioate
  modified_base 106: mod_base = um
  modified_base 107: mod_base = cm
  source 1..107: mol_type = other RNA

SEQ ID NO: 3158 - RNA, 119 nt, synthetic construct
  source 1..119: mol_type = other RNA
actggcgcttctatctgattactctgagcgccatcaccagcgactatgtcgtagtgggtaaagccgcttacggacttcggtccgtaagaggcatcagagtcctggcttcctggtgaaga

SEQ ID NO: 3159 - RNA, 119 nt, synthetic construct; identical to SEQ ID NO: 3158
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 117: mod_base = OTHER; note = 2'-O-methyladenosine
  modified_base 117..119: mod_base = OTHER; note = linked by phosphorothioate
  modified_base 118: mod_base = gm
  modified_base 119: mod_base = OTHER; note = 2'-O-methyladenosine
  source 1..119: mol_type = other RNA

SEQ ID NO: 3160 - RNA, 123 nt, synthetic construct
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 120..123: mod_base = OTHER; note = linked by phosphorothioate
  modified_base 121: mod_base = um
  modified_base 122: mod_base = um
  modified_base 123: mod_base = um
  source 1..123: mol_type = other RNA
actggcgcttctatctgattactctgagcgccatcaccagcgactatgtcgtagtgggtaaagccgcttacggacttcggtccgtaagaggcatcagagtcctggcttcctggtgaagatttt

SEQ ID NO: 3161 - RNA, 119 nt, synthetic construct; identical to SEQ ID NO: 3158
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = gm
  modified_base 6: mod_base = cm
  modified_base 7: mod_base = gm
  modified_base 8: mod_base = cm
  modified_base 9: mod_base = um
  modified_base 10: mod_base = um
  modified_base 11: mod_base = cm
  modified_base 12: mod_base = um
  modified_base 13: mod_base = OTHER; note = 2'-O-methyladenosine
  modified_base 14: mod_base = um
  modified_base 15: mod_base = cm
  modified_base 16: mod_base = um
  modified_base 17: mod_base = gm
  modified_base 18: mod_base = OTHER; note = 2'-O-methyladenosine
  modified_base 19: mod_base = um
  modified_base 27: mod_base = OTHER; note = 2'-O-methyladenosine
  modified_base 28: mod_base = gm
  modified_base 29: mod_base = cm
  modified_base 30: mod_base = gm
  modified_base 31: mod_base = cm
  modified_base 32: mod_base = cm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 38: mod_base = cm
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 57: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 93: mod_base = OTHER; note = 2'-O-methyladenosine
  modified_base 94: mod_base = um
  modified_base 95: mod_base = cm
  modified_base 96: mod_base = OTHER; note = 2'-O-methyladenosine
  modified_base 117: mod_base = OTHER; note = 2'-O-methyladenosine
  modified_base 117..119: mod_base = OTHER; note = linked by phosphorothioate
  modified_base 118: mod_base = gm
  modified_base 119: mod_base = OTHER; note = 2'-O-methyladenosine
  source 1..119: mol_type = other RNA

SEQ ID NO: 3162 - RNA, 119 nt, synthetic construct; identical to SEQ ID NO: 3158
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = gm
  modified_base 6: mod_base = cm
  modified_base 7: mod_base = gm
  modified_base 8: mod_base = cm
  modified_base 13: mod_base = OTHER; note = 2'-O-methyladenosine
  modified_base 14: mod_base = um
  modified_base 15: mod_base = cm
  modified_base 16: mod_base = um
  modified_base 17: mod_base = gm
  modified_base 18: mod_base = OTHER; note = 2'-O-methyladenosine
  modified_base 19: mod_base = um
  modified_base 27: mod_base = OTHER; note = 2'-O-methyladenosine
  modified_base 28: mod_base = gm
  modified_base 29: mod_base = cm
  modified_base 30: mod_base = gm
  modified_base 31: mod_base = cm
  modified_base 32: mod_base = cm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 38: mod_base = cm
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 57: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 93: mod_base = OTHER; note = 2'-O-methyladenosine
  modified_base 94: mod_base = um
  modified_base 117: mod_base = OTHER; note = 2'-O-methyladenosine
  modified_base 117..119: mod_base = OTHER; note = linked by phosphorothioate
  modified_base 118: mod_base = gm
  modified_base 119: mod_base = OTHER; note = 2'-O-methyladenosine
  source 1..119: mol_type = other RNA

SEQ ID NO: 3163 - RNA, 119 nt, synthetic construct; identical to SEQ ID NO: 3158
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 117: mod_base = OTHER; note = 2'-O-methyladenosine
  modified_base 117..119: mod_base = OTHER; note = linked by phosphorothioate
  modified_base 118: mod_base = gm
  modified_base 119: mod_base = OTHER; note = 2'-O-methyladenosine
  source 1..119: mol_type = other RNA

SEQ ID NO: 3164 - RNA, 119 nt, synthetic construct; identical to SEQ ID NO: 3158
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 117: mod_base = OTHER; note = 2'-O-methyladenosine
  modified_base 117..119: mod_base = OTHER; note = linked by phosphorothioate
  modified_base 118: mod_base = gm
  modified_base 119: mod_base = OTHER; note = 2'-O-methyladenosine
  source 1..119: mol_type = other RNA

SEQ ID NO: 3165 - RNA, 119 nt, synthetic construct
  source 1..119: mol_type = other RNA
actggcgcttctatctgattactctgagcgccatcaccagcgactatgtcgtagtgggtaaagccgcttacggacttcggtccgtaagaggcatcagagtggcttcctggtgaagatga

SEQ ID NO: 3166 - RNA, 119 nt, synthetic construct; identical to SEQ ID NO: 3165
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 117: mod_base = um
  modified_base 117..119: mod_base = OTHER; note = linked by phosphorothioate
  modified_base 118: mod_base = gm
  modified_base 119: mod_base = OTHER; note = 2'-O-methyladenosine
  source 1..119: mol_type = other RNA

SEQ ID NO: 3167 - RNA, 122 nt, synthetic construct
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 119..122: mod_base = OTHER; note = linked by phosphorothioate
  modified_base 120: mod_base = um
  modified_base 121: mod_base = um
  modified_base 122: mod_base = um
  source 1..122: mol_type = other RNA
actggcgcttctatctgattactctgagcgccatcaccagcgactatgtcgtagtgggtaaagccgcttacggacttcggtccgtaagaggcatcagagtggcttcctggtgaagatgattt

SEQ ID NO: 3168 - RNA, 119 nt, synthetic construct; identical to SEQ ID NO: 3165
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = gm
  modified_base 6: mod_base = cm
  modified_base 7: mod_base = gm
  modified_base 8: mod_base = cm
  modified_base 9: mod_base = um
  modified_base 10: mod_base = um
  modified_base 11: mod_base = cm
  modified_base 12: mod_base = um
  modified_base 13: mod_base = OTHER; note = 2'-O-methyladenosine
  modified_base 14: mod_base = um
  modified_base 15: mod_base = cm
  modified_base 16: mod_base = um
  modified_base 17: mod_base = gm
  modified_base 18: mod_base = OTHER; note = 2'-O-methyladenosine
  modified_base 19: mod_base = um
  modified_base 27: mod_base = OTHER; note = 2'-O-methyladenosine
  modified_base 28: mod_base = gm
  modified_base 29: mod_base = cm
  modified_base 30: mod_base = gm
  modified_base 31: mod_base = cm
  modified_base 32: mod_base = cm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 38: mod_base = cm
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 57: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 93: mod_base = OTHER; note = 2'-O-methyladenosine
  modified_base 94: mod_base = um
  modified_base 95: mod_base = cm
  modified_base 96: mod_base = OTHER; note = 2'-O-methyladenosine
  modified_base 117: mod_base = um
  modified_base 117..119: mod_base = OTHER; note = linked by phosphorothioate
  modified_base 118: mod_base = gm
  modified_base 119: mod_base = OTHER; note = 2'-O-methyladenosine
  source 1..119: mol_type = other RNA

SEQ ID NO: 3169 - RNA, 119 nt, synthetic construct; identical to SEQ ID NO: 3165
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = gm
  modified_base 6: mod_base = cm
  modified_base 7: mod_base = gm
  modified_base 8: mod_base = cm
  modified_base 13: mod_base = OTHER; note = 2'-O-methyladenosine
  modified_base 14: mod_base = um
  modified_base 15: mod_base = cm
  modified_base 16: mod_base = um
  modified_base 17: mod_base = gm
  modified_base 18: mod_base = OTHER; note = 2'-O-methyladenosine
  modified_base 19: mod_base = um
  modified_base 27: mod_base = OTHER; note = 2'-O-methyladenosine
  modified_base 28: mod_base = gm
  modified_base 29: mod_base = cm
  modified_base 30: mod_base = gm
  modified_base 31: mod_base = cm
  modified_base 32: mod_base = cm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 38: mod_base = cm
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 57: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 93: mod_base = OTHER; note = 2'-O-methyladenosine
  modified_base 94: mod_base = um
  modified_base 117: mod_base = um
  modified_base 117..119: mod_base = OTHER; note = linked by phosphorothioate
  modified_base 118: mod_base = gm
  modified_base 119: mod_base = OTHER; note = 2'-O-methyladenosine
  source 1..119: mol_type = other RNA

SEQ ID NO: 3170 - RNA, 119 nt, synthetic construct; identical to SEQ ID NO: 3165
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 117: mod_base = um
  modified_base 117..119: mod_base = OTHER; note = linked by phosphorothioate
  modified_base 118: mod_base = gm
  modified_base 119: mod_base = OTHER; note = 2'-O-methyladenosine
  source 1..119: mol_type = other RNA

SEQ ID NO: 3171 - RNA, 119 nt, synthetic construct; identical to SEQ ID NO: 3165
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 60: mod_base = OTHER; note = 2'-O-methyladenosine
  modified_base 61: mod_base = OTHER; note = 2'-O-methyladenosine
  modified_base 62: mod_base = OTHER; note = 2'-O-methyladenosine
  modified_base 63: mod_base = gm
  modified_base 64: mod_base = cm
  modified_base 65: mod_base = cm
  modified_base 66: mod_base = gm
  modified_base 67: mod_base = cm
  modified_base 68: mod_base = um
  modified_base 69: mod_base = um
  modified_base 70: mod_base = OTHER; note = 2'-O-methyladenosine
  modified_base 71: mod_base = cm
  modified_base 72: mod_base = gm
  modified_base 73: mod_base = gm
  modified_base 74: mod_base = OTHER; note = 2'-O-methyladenosine
  modified_base 75: mod_base = cm
  modified_base 76: mod_base = um
  modified_base 77: mod_base = um
  modified_base 78: mod_base = cm
  modified_base 79: mod_base = gm
  modified_base 80: mod_base = gm
  modified_base 81: mod_base = um
  modified_base 82: mod_base = cm
  modified_base 83: mod_base = cm
  modified_base 84: mod_base = gm
  modified_base 85: mod_base = um
  modified_base 86: mod_base = OTHER; note = 2'-O-methyladenosine
  modified_base 87: mod_base = OTHER; note = 2'-O-methyladenosine
  modified_base 88: mod_base = gm
  modified_base 89: mod_base = OTHER; note = 2'-O-methyladenosine
  modified_base 90: mod_base = gm
  modified_base 91: mod_base = gm
  modified_base 92: mod_base = cm
  modified_base 117: mod_base = um
  modified_base 117..119: mod_base = OTHER; note = linked by phosphorothioate
  modified_base 118: mod_base = gm
  modified_base 119: mod_base = OTHER; note = 2'-O-methyladenosine
  source 1..119: mol_type = other RNA

SEQ ID NO: 3172 - RNA, 109 nt, synthetic construct
  source 1..109: mol_type = other RNA
actggcgcttctatctgattactctgagcgccatcaccagcgactatgtcgtagtgggtaaagctccctcttcggagggagcatcagagctggcttcttggtgaagatg

SEQ ID NO: 3173 - RNA, 109 nt, synthetic construct; identical to SEQ ID NO: 3172
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 106..109: mod_base = OTHER; note = linked by phosphorothioate
  modified_base 107: mod_base = OTHER; note = 2'-O-methyladenosine
  modified_base 108: mod_base = um
  modified_base 109: mod_base = gm
  source 1..109: mol_type = other RNA

SEQ ID NO: 3174 - RNA, 109 nt, synthetic construct; identical to SEQ ID NO: 3172
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 6: mod_base = cm
  modified_base 8: mod_base = cm
  modified_base 9: mod_base = um
  modified_base 14: mod_base = um
  modified_base 15: mod_base = cm
  modified_base 27: mod_base = OTHER; note = 2'-O-methyladenosine
  modified_base 28: mod_base = gm
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 42: mod_base = gm
  modified_base 43: mod_base = OTHER; note = 2'-O-methyladenosine
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 83: mod_base = OTHER; note = 2'-O-methyladenosine
  modified_base 84: mod_base = um
  modified_base 106..109: mod_base = OTHER; note = linked by phosphorothioate
  modified_base 107: mod_base = OTHER; note = 2'-O-methyladenosine
  modified_base 108: mod_base = um
  modified_base 109: mod_base = gm
  source 1..109: mol_type = other RNA

SEQ ID NO: 3175 - RNA, 109 nt, synthetic construct; identical to SEQ ID NO: 3172
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 33: mod_base = OTHER; note = 2'-O-methyladenosine
  modified_base 34: mod_base = um
  modified_base 35: mod_base = cm
  modified_base 36: mod_base = OTHER; note = 2'-O-methyladenosine
  modified_base 37: mod_base = cm
  modified_base 42: mod_base = gm
  modified_base 43: mod_base = OTHER; note = 2'-O-methyladenosine
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 58: mod_base = gm
  modified_base 59: mod_base = um
  modified_base 60: mod_base = OTHER; note = 2'-O-methyladenosine
  modified_base 61: mod_base = OTHER; note = 2'-O-methyladenosine
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 83: mod_base = OTHER; note = 2'-O-methyladenosine
  modified_base 84: mod_base = um
  modified_base 106..109: mod_base = OTHER; note = linked by phosphorothioate
  modified_base 107: mod_base = OTHER; note = 2'-O-methyladenosine
  modified_base 108: mod_base = um
  modified_base 109: mod_base = gm
  source 1..109: mol_type = other RNA

SEQ ID NO: 3176 - RNA, 109 nt, synthetic construct; identical to SEQ ID NO: 3172
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 6: mod_base = cm
  modified_base 8: mod_base = cm
  modified_base 9: mod_base = um
  modified_base 14: mod_base = um
  modified_base 15: mod_base = cm
  modified_base 27: mod_base = OTHER; note = 2'-O-methyladenosine
  modified_base 28: mod_base = gm
  modified_base 42: mod_base = gm
  modified_base 43: mod_base = OTHER; note = 2'-O-methyladenosine
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 105..109: mod_base = OTHER; note = linked by phosphorothioate
  modified_base 106: mod_base = gm
  modified_base 107: mod_base = OTHER; note = 2'-O-methyladenosine
  modified_base 108: mod_base = um
  modified_base 109: mod_base = gm
  source 1..109: mol_type = other RNA

SEQ ID NO: 3177 - RNA, 109 nt, synthetic construct
  source 1..109: mol_type = other RNA
actggcgcttttatctgattactttgagagccatcaccagcgactatgtcgtagtgggtaaagctccctcttcggagggagcatcaaagagaagatgggcgggagtctt

SEQ ID NO: 3178 - RNA, 112 nt, synthetic construct
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 109..112: mod_base = OTHER; note = linked by phosphorothioate
  modified_base 110: mod_base = um
  modified_base 111: mod_base = um
  modified_base 112: mod_base = um
  source 1..112: mol_type = other RNA
actggcgcttttatctgattactttgagagccatcaccagcgactatgtcgtagtgggtaaagctccctcttcggagggagcatcaaagagaagatgggcgggagtcttttt

SEQ ID NO: 3179 - RNA, 109 nt, synthetic construct
  source 1..109: mol_type = other RNA
actggcgcttctatctgattactctgagcgccatcaccagcgactatgtcgtagtgggtaaagctccctcttcggagggagcatcagagagaagatgggcgggagtctt

SEQ ID NO: 3180 - RNA, 109 nt, synthetic construct; identical to SEQ ID NO: 3179
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 106..109: mod_base = OTHER; note = linked by phosphorothioate
  modified_base 107: mod_base = cm
  modified_base 108: mod_base = um
  modified_base 109: mod_base = um
  source 1..109: mol_type = other RNA

SEQ ID NO: 3181 - RNA, 109 nt, synthetic construct; identical to SEQ ID NO: 3179
  modified_base 1..4: mod_base = OTHER; note = linked by phosphorothioate
  modified_base 1: mod_base = OTHER; note = 2'-O-methyladenosine
  modified_base 2: mod_base = cm
  modified_base 3: mod_base = um
  modified_base 44: mod_base = cm
  modified_base 45: mod_base = um
  modified_base 48: mod_base = gm
  modified_base 49: mod_base = um
  modified_base 50: mod_base = cm
  modified_base 51: mod_base = gm
  modified_base 63: mod_base = gm
  modified_base 64: mod_base = cm
  modified_base 65: mod_base = um
  modified_base 66: mod_base = cm
  modified_base 67: mod_base = cm
  modified_base 68: mod_base = cm
  modified_base 69: mod_base = um
  modified_base 70: mod_base = cm
  modified_base 71: mod_base = um
  modified_base 72: mod_base = um
  modified_base 73: mod_base = cm
  modified_base 74: mod_base = gm
  modified_base 75: mod_base = gm
  modified_base 76: mod_base = OTHER; note = 2'-O-methyladenosine
  modified_base 77: mod_base = gm
  modified_base 78: mod_base = gm
  modified_base 79: mod_base = gm
  modified_base 80: mod_base = OTHER; note = 2'-O-methyladenosine
  modified_base 81: mod_base = gm
  modified_base 82: mod_base = cm
  modified_base 106..109: mod_base = OTHER; note = linked by phosphorothioate
  modified_base 107: mod_base = cm
  modified_base 108: mod_base = um
  modified_base 109: mod_base = um
  source 1..109: mol_type = other RNA

SEQ ID NO: 3182 - DNA, 60 bp, synthetic construct
  source 1..60: mol_type = other DNA
  misc_feature 1: note = IRDye700 moiety conjugated
catgtcttccatggccttcttcctggcttcctggtgaagatgagtggcgacctgctggag

SEQ ID NO: 3183 - DNA, 60 bp, synthetic construct
  source 1..60: mol_type = other DNA
  misc_feature 1: note = IRDye800 moiety conjugated
ctccagcaggtcgccactcatcttcaccaggaagccaggaagaaggccatggaagacatg

SEQ ID NO: 3184 - DNA, 39 bp, synthetic construct
  source 1..39: mol_type = other DNA
atggccccagcggccaaacgggtgaagctggactctaga

SEQ ID NO: 3185 - DNA, 2931 bp, synthetic construct
  source 1..2931: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 3186 - DNA, 42 bp, synthetic construct
  source 1..42: mol_type = other DNA
ggctcccccgccgcgaagcgagtgaaactggacggatccggc

SEQ ID NO: 3187 - DNA, 756 bp, synthetic construct
  source 1..756: mol_type = other DNA
gcaacaaacttctctctgctgaaacaagccggagatgtcgaagagaatcctggaccgatggtatcaaagggtgaggcggtcattaaggaattcatgcggttcaaagttcacatggaggggagtatgaatggtcacgaatttgagatcgagggtgagggagagggtagaccttacgaaggcacccagacagcaaaactcaaagtcactaagggcggcccactccctttctcatgggatatactgagtcctcaatttatgtatggctcccgggcctttatcaagcatccagccgacatacccgattactataaacagtcattccccgagggattcaaatgggagagagtgatgaattttgaagacgggggtgccgtgaccgtaactcaagatacctctttggaagatggtaccctcatttacaaggttaagcttagaggaactaatttcccaccagacggacccgttatgcagaaaaaaaccatgggttgggaggctagcaccgaacggctgtatccagaggatggagttttgaaaggtgatattaagatggccctgcgcctgaaagacggagggcggtacctcgcagatttcaaaactacctacaaagctaagaaaccggtccaaatgccgggtgcttataacgtcgataggaagctggatataacatcacacaacgaagactatacggttgtcgaacagtatgagcgatctgaggggaggcacagcacgggcgggatggatgagctttacaagtga

SEQ ID NO: 3188 - DNA, 40 bp, synthetic construct
  source 1..40: mol_type = other DNA
actcttctggtccccacagactcagagagaacccgccacc

SEQ ID NO: 3189 - DNA, 111 bp, synthetic construct
  source 1..111: mol_type = other DNA
gctggagcctcggtggccatgcttcttgccccttgggcctccccccagcccctcctccccttcctgcacccgtacccccgtggtctttgaataaagtctgagtgggcggca

SEQ ID NO: 3190 - RNA, 3249 nt, synthetic construct
  source 1..3249: mol_type = other RNA
  modified_base order(3,5,6,8,11,22,42,49,52,63,69,73,87,96,97,100,105,106,117,120,127,128,130,145,163,165,174,177,180,186,189,201,213,222,235,241,243,255,279,283,288,291,299,309,321,324,330,332,334,335,344,345,360,366,369,378,382,388,402,406,417,429,447,461,462,463,467,469,476,489,491,492,493,495,497,504,513,532,533,541,542,545,546,554,561,579,582,588,597,604,613,619,627,632,634,635,639,647,648,663,667,668,669,670,671,673,674,678,679,682,684,695,708,715,717,718,726,727,740,746,756,768,779,781,783,792,800,801,804,806,808,812,822,823,825,828,843,846,867,876,885,903,908,910,913,918,924,928,931,937,940,954,958,962,972,975,984,990,992,996,1002,1006,1008,1010,1020,1026,1028,1030,1050,1053,1059,1067,1068,1076,1077,1081,1083,1086,1102,1107,1112,1115,1122,1125,1127,1129,1134,1143,1146,1150,1173,1175,1176,1178,1186,1188,1196,1204,1215,1223,1227,1262,1263,1271,1273,1278,1287,1290,1293,1299,1322,1332,1334,1339,1346,1356,1360,1368,1377,1389,1395,1412,1414,1440,1448,1452,1469,1470,1473,1476,1485,1508,1509,1511,1517,1524,1530,1538,1541,1549,1551,1564,1565,1566,1572,1590,1593,1599,1607,1608,1619,1625,1631,1632,1633,1635,1636,1637,1653,1662,1668,1670,1674,1677,1680,1685,1687,1688,1689,1704,1709,1710,1719,1726,1733,1734,1748,1749,1751,1758,1761,1762,1782,1785,1791,1797,1802,1803,1808,1809,1819,1824,1827,1830,1833,1839,1844,1845,1846,1868,1869,1872,1874,1884,1887,1889,1891,1893,1908,1914,1929,1932,1944,1946,1980,1982,1983,1984,1986,1992,1997,1998,2013,2016,2029,2031,2038,2040,2046,2049,2055,2073,2077,2082,2085,2091,2092,2108,2113,2115,2123,2124,2125,2136,2146,2154,2157,2163,2164,2171,2174,2196,2214,2230,2237,2240,2249,2271,2283,2286,2287,2293,2307,2310,2312,2315,2320,2322,2337,2340,2343,2345,2346,2355,2366,2367,2390,2391,2394,2408,2418,2426,2430,2442,2447,2457,2462,2464,2471,2475,2477,2486,2487,2495,2510,2513,2515,2519,2525,2526,2532,2546,2556,2559,2568,2588,2592,2601,2602,2616,2622,2634,2639,2642,2651,2667,2670,2679,2685,2691,2695,2700,2715,2722,2727,2735,2763,2769,2772,2783,2784,2786,2799,2810,2811,2814,2816,2818,2820,2825,2831,2832,2862,2868,2876,2878,2879,2883,2884,2885,2886,2889,2903,2912,2954,2955,2958,2966,2975,2976,2978,2991,3000,3002,3010,3015,3028,3039,3045,3050,3053,3057,3062,3069,3073,3079,3082,3083,3085,3086,3092,3093,3099,3112,3115,3120,3121,3124,3132,3140,3143,3145,3146,3147,3151,3156,3158,3162): mod_base = m1f
actcttctggtccccacagactcagagagaacccgccaccatggcccctgctgccaagagagtgaagctggatagcagacaggagatcaagcggattaataaaattcggagaagactggtgaaggattctaacacaaagaaggctggcaagacacggggccctatgaagacactgctggtgagagtgatgacacccgacctgagagaaagactggaaaacctgagaaagaagcctgagaatatcccccagcccatcagcaacacaagccgggccaacctgaataagctgctgaccgactacaccgaaatgaagaaggccatcctgcacgtgtattgggaagagttccagaaagacccagtcggcctgatgagcagagtggctcagcctgccagcaagaagatcgatcagaacaagctgaagcccgaaatggacgagaaggggaacctgacaaccgccggctttgcctgtagccagtgcggccagcccctgtttgtgtacaaactggaacaggtgagcgaaaagggcaaggcttacacgaattacttcggcagatgcaacgtggccgagcacgagaagctgatcaagctggcccagctgaagcctgagaaggatagcgatgaggcagtgacatattccctgggcaagttcggacagcgggccctggatttttattccattcatgtgaccaaggaatccacccaccccgtcaagcctcttgcccaaattgccggcaacagatacgcctccagccccgtgggcaaggccctgagcgacgcctgtatgggcaccatcgccagcttcctgtctaagtaccaggacattatcatcgagcaccagaaggtggtgaagggcaaccagaagagactggagagcctgcgcgagctggccggcaaggaaaacctggagtatcctagcgtgaccctgcctcctcagcctcatacaaaggagggcgtggatgcctacaacgaagtgatcgcccgggtgcggatgtgggtgaacctgaatctgtggcagaagctgaagctgtctagagacgacgccaagcccctgctgagactgaagggcttccccagcttccctctggtggagagacaggcaaatgaagtggactggtgggacatggtgtgtaacgtgaagaagctgatcaatgagaagaaggaggacggcaaagtgttctggcagaatctggccggctacaagcgtcaggaggccctgcggccctacctgagcagcgaggaagacagaaagaagggcaagaagttcgcccggtatcagctgggggacctgctgctgcacctcgagaagaagcacggcgaagactgggggaaggtgtacgatgaggcctgggagcggatcgataagaaggtggagggcctgagcaagcacatcaagctggaggaggaacggagatctgaggacgcccagagcaaggccgccctgaccgactggctgagagccaaggccagcttcgtcatcgaggggctgaaggaggccgacaaggacgagttctgccggtgcgaactgaagctgcagaagtggtacggagatctgagaggcaaacctttcgccatcgaggccgagaacagcatcctggacatcagcggcttcagcaagcagtacaactgcgcctttatttggcagaaggacggagtgaagaagctgaacctgtacctgatcatcaactatttcaagggcggcaagctgagattcaagaagatcaagcctgaagccttcgaggccaacagattctacaccgtgattaacaagaaaagcggagagatcgtgccaatggaagtgaacttcaacttcgacgaccctaacctgatcatcctgcccctggcatttggcaagcggcagggcagagagttcatctggaacgacctgctgtctctggagaccggcagcctgaagctggccaacggcagagtgatcgagaagacactgtacaacagacgaaccagacaagacgagcccgccctgtttgtggccctgaccttcgagagaagagaggtgctggacagcagcaatatcaagcctatgaacctgatcggcgtggaccggggcgagaacatccctgccgtgatcgcccttaccgaccccgagggatgccctctgagccggtttaaagacagcctgggcaaccctacccacatcctgagaattggcgagtcctacaaggagaagcagagaaccatccaggccaagaaggaggtggagcagcggcgggctggcggctactcccggaagtacgccagcaaggccaagaacctggccgacgacatggttagaaataccgccagagacctcctgtactacgctgtgacccaggacgccatgctgatcttcgagaacctgagcagaggcttcggcagacagggcaagagaaccttcatggccgagagacagtacacccggatggaggactggctgaccgccaagctggcctacgagggcctgccctctaagacctacctgtccaagaccttggcacagtacaccagcaagacatgctctaactgcggcttcacaatcacgagcgccgactacgaccgggtgctggagaaactgaagaagaccgccacaggctggatgaccaccattaacggcaaggagctgaaggtggagggccagatcacctactacaacaggtacaaacggcagaacgtggtgaaggacctgagcgtggaactggatagactgagcgaggaaagcgtaaacaatgacatcagcagctggaccaagggccggagcggcgaggccctgagcctgctgaagaagagattctcccacagaccagtgcaggagaagttcgtgtgtctgaactgcggcttcgagacccacgccgacgagcaagccgccctgaacatcgcccggtcttggcttttcctgcggagccaggagtacaagaagtaccagacaaacaagaccacaggcaacacagacaagagagccttcgtcgagacctggcagagcttctacagaaagaagctgaaggaggtgtggaagcctgccgtgggaagccccgctgccaagagagtgaagctggactaatagataagctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3191 - skipped

SEQ ID NO: 3192 - RNA, 20 nt, synthetic construct
  source 1..20: mol_type = other RNA
ccaagaagccagggaagagg

SEQ ID NO: 3193 - RNA, 20 nt, synthetic construct
  source 1..20: mol_type = other RNA
acatatcttttatgacctct

SEQ ID NO: 3194 - RNA, 20 nt, synthetic construct
  source 1..20: mol_type = other RNA
ctggcttcttggtgaagatg

SEQ ID NO: 3195 - RNA, 20 nt, synthetic construct
  source 1..20: mol_type = other RNA
tggtgaagatgagcagtgac

SEQ ID NO: 3196 - RNA, 20 nt, synthetic construct
  source 1..20: mol_type = other RNA
gccgttgctccaaggtatgg

SEQ ID NO: 3197 - RNA, 20 nt, synthetic construct
  source 1..20: mol_type = other RNA
ttcttggggatcaggaggcc

SEQ ID NO: 3198 - RNA, 120 nt, synthetic construct
  source 1..120: mol_type = other RNA
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3199 - RNA, 126 nt, synthetic construct
  source 1..126: mol_type = other RNA
aaaaaaaaaaaaaaaaaaaaaaaaaaaaaaaaaaaaaaaaaaaaaaaaaaaaaaaaaaaagcatgcaaaaaaaaaaaaaaaaaaaaaaaaaaaaaaaaaaaaaaaaaaaaaaaaaaaaaaaaaaaa

SEQ ID NO: 3200 - DNA, 34 bp, synthetic construct
  source 1..34: mol_type = other DNA
actcttctggtccccacagactcagagagaaccc

SEQ ID NO: 3201 - DNA, 44 bp, synthetic construct
  source 1..44: mol_type = other DNA
acatttgcttctgacacaactgtgttcactagcaacctcaaaca

SEQ ID NO: 3202 - DNA, 35 bp, synthetic construct
  source 1..35: mol_type = other DNA
ctagcttttctcttctgtcaaccccacacgccttt

SEQ ID NO: 3203 - DNA, 27 bp, synthetic construct
  source 1..27: mol_type = other DNA
ctcccgggctggcagcagggccccagc

SEQ ID NO: 3204 - DNA, 55 bp, synthetic construct
  source 1..55: mol_type = other DNA
actcctccccatcctctccctctgtccctctgtccctctgaccctgcactgtccc

SEQ ID NO: 3205 - DNA, 414 bp, synthetic construct
  source 1..414: mol_type = other DNA
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagttatggattataaacattcaaaataatattttgacattatgataattctgaataaaagaacaaaaacca

SEQ ID NO: 3206 - DNA, 193 bp, synthetic construct
  source 1..193: mol_type = other DNA
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatct

SEQ ID NO: 3207 - DNA, 134 bp, synthetic construct
  source 1..134: mol_type = other DNA
gctcgctttcttgctgtccaatttctattaaaggttcctttgttccctaagtccaactactaaactgggggatattatgaagggccttgagcatctggattctgcctaataaaaaacatttattttcattgcaa

SEQ ID NO: 3208 - DNA, 245 bp, synthetic construct
  source 1..245: mol_type = other DNA
gctggagcctcggtggccatgcttcttgccccttgggcctccccccagcccctcctccccttcctgcacccgtacccccgtggtctttgaataaagtctgagtgggcggcagctcgctttcttgctgtccaatttctattaaaggttcctttgttccctaagtccaactactaaactgggggatattatgaagggccttgagcatctggattctgcctaataaaaaacatttattttcattgcaa

SEQ ID NO: 3209 - DNA, 245 bp, synthetic construct
  source 1..245: mol_type = other DNA
gctcgctttcttgctgtccaatttctattaaaggttcctttgttccctaagtccaactactaaactgggggatattatgaagggccttgagcatctggattctgcctaataaaaaacatttattttcattgcaagctggagcctcggtggccatgcttcttgccccttgggcctccccccagcccctcctccccttcctgcacccgtacccccgtggtctttgaataaagtctgagtgggcggca

SEQ ID NO: 3210 - DNA, 99 bp, synthetic construct
  source 1..99: mol_type = other DNA
actgggccttctatctgattactctgaggcccatcaccagcgactatgtcgtagtgggtaaagccgcttagggacttcggtccctaagaggcatcagag

SEQ ID NO: 3211 - DNA, 97 bp, synthetic construct
  source 1..97: mol_type = other DNA
actgggccttctatctgattactctgaggcccatcaccagcgactatgtcgtagtgggtaaagcccttagggacttcggtccctaagggcatcagag

SEQ ID NO: 3212 - DNA, 99 bp, synthetic construct
  source 1..99: mol_type = other DNA
actgggccttctatctgattactctgaggcccatcaccagcgactatgtcgtagtgggtaaagcctcttagggacttcggtccctaagaggcatcagag

SEQ ID NO: 3213 - DNA, 89 bp, synthetic construct
  source 1..89: mol_type = other DNA
actgggccttctatctgattactctgaggcccatcaccagcgactatgtcgtagtgggtaaagctccctcttcggagggagcatcagag

SEQ ID NO: 3214 - DNA, 97 bp, synthetic construct
  source 1..97: mol_type = other DNA
actgggccttctatctgattactctgaggcccatcaccagcgactatgtcgtagtgggtaaagcccttagggaccttggtccctaagggcatcagag

SEQ ID NO: 3215 - DNA, 99 bp, synthetic construct
  source 1..99: mol_type = other DNA
actgggccttctatctgattactctgaggcccatcaccagcgactatgtcgtagtgggtaaagcctcttagggaccttggtccctaagaggcatcagag

SEQ ID NO: 3216 - DNA, 89 bp, synthetic construct
  source 1..89: mol_type = other DNA
actgggccttctatctgattactctgaggcccatcaccagcgactatgtcgtagtgggtaaagctccctccttggagggagcatcagag

SEQ ID NO: 3217 - DNA, 97 bp, synthetic construct
  source 1..97: mol_type = other DNA
actgggccttctatctgattactctgaggcccatcaccagcgactatgtcgtagtgggtaaagcccttagggaggaaactccctaagggcatcagag

SEQ ID NO: 3218 - DNA, 99 bp, synthetic construct
  source 1..99: mol_type = other DNA
actgggccttctatctgattactctgaggcccatcaccagcgactatgtcgtagtgggtaaagcctcttagggaggaaactccctaagaggcatcagag

SEQ ID NO: 3219 - DNA, 89 bp, synthetic construct
  source 1..89: mol_type = other DNA
actgggccttctatctgattactctgaggcccatcaccagcgactatgtcgtagtgggtaaagctccctggaaacagggagcatcagag

SEQ ID NO: 3220 - DNA, 98 bp, synthetic construct
  source 1..98: mol_type = other DNA
actgggccttctatctgattactctgaggcccatcaccagcgactatgtcgtagtgggtaaagcccttagggacttcaggtccctaagggcatcagag

SEQ ID NO: 3221 - DNA, 100 bp, synthetic construct
  source 1..100: mol_type = other DNA
actgggccttctatctgattactctgaggcccatcaccagcgactatgtcgtagtgggtaaagcctcttagggacttcaggtccctaagaggcatcagag

SEQ ID NO: 3222 - DNA, 90 bp, synthetic construct
  source 1..90: mol_type = other DNA
actgggccttctatctgattactctgaggcccatcaccagcgactatgtcgtagtgggtaaagctccctcttcaggagggagcatcagag

SEQ ID NO: 3223 - DNA, 97 bp, synthetic construct
  source 1..97: mol_type = other DNA
actgggccttctatctgattactctgaggcccatcaccaggcactatgtgctagtgggtaaagcccttagggaccttggtccctaagggcatcagag

SEQ ID NO: 3224 - DNA, 99 bp, synthetic construct
  source 1..99: mol_type = other DNA
actgggccttctatctgattactctgaggcccatcaccaggcactatgtgctagtgggtaaagcctcttagggaccttggtccctaagaggcatcagag

SEQ ID NO: 3225 - DNA, 89 bp, synthetic construct
  source 1..89: mol_type = other DNA
actgggccttctatctgattactctgaggcccatcaccaggcactatgtgctagtgggtaaagctccctccttggagggagcatcagag

SEQ ID NO: 3226 - DNA, 97 bp, synthetic construct
  source 1..97: mol_type = other DNA
actgggccttctatctgattactctgaggcccatcaccaggcactatgtgctagtgggtaaagcccttagggaggaaactccctaagggcatcagag

SEQ ID NO: 3227 - DNA, 99 bp, synthetic construct
  source 1..99: mol_type = other DNA
actgggccttctatctgattactctgaggcccatcaccaggcactatgtgctagtgggtaaagcctcttagggaggaaactccctaagaggcatcagag

SEQ ID NO: 3228 - DNA, 89 bp, synthetic construct
  source 1..89: mol_type = other DNA
actgggccttctatctgattactctgaggcccatcaccaggcactatgtgctagtgggtaaagctccctggaaacagggagcatcagag

SEQ ID NO: 3229 - DNA, 98 bp, synthetic construct
  source 1..98: mol_type = other DNA
actgggccttctatctgattactctgaggcccatcaccaggcactatgtgctagtgggtaaagcccttagggacttcaggtccctaagggcatcagag

SEQ ID NO: 3230 - DNA, 100 bp, synthetic construct
  source 1..100: mol_type = other DNA
actgggccttctatctgattactctgaggcccatcaccaggcactatgtgctagtgggtaaagcctcttagggacttcaggtccctaagaggcatcagag

SEQ ID NO: 3231 - DNA, 90 bp, synthetic construct
  source 1..90: mol_type = other DNA
actgggccttctatctgattactctgaggcccatcaccaggcactatgtgctagtgggtaaagctccctcttcaggagggagcatcagag

SEQ ID NO: 3232 - RNA, 20 nt, synthetic construct
  source 1..20: mol_type = other RNA
cgagacgtaattacgtctcg

SEQ ID NO: 3233 - DNA, 130 bp, synthetic construct
  source 1..130: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcct

SEQ ID NO: 3234 - DNA, 252 bp, synthetic construct
  source 1..252: mol_type = other DNA
aatggaggtggtactatgtagatgagaattcaggagcaaactgggaaaagcaactgcttccaaatatttgtgatttttacagtgtagttttggaaaaactcttagcctaccaattcttctaagtgttttaaaatgtgggagccagtacacatgaagttatagagtgttttaatgaggcttaaatatttactgtaactatgaaatgctacacatatcatgctgttcaggctctgtggccatgcaactcatact

SEQ ID NO: 3235 - DNA, 3006 bp, synthetic construct
  source 1..3006: mol_type = other DNA
atggctccagctgccaagagagtgaagctggactctagacaagagatcaagaggatcaacaagattagaagaaggctggtcaaggacagcaacaccaagaaggcaggcaagacaggccccatgaagaccctgcttgtcagagtgatgacccctgacctgagagagagactggaaaacctgagaaagaagcctgagaacatccctcagcctatctccaacaccagcagagccaacctgaacaagctgctgacagactacacagagatgaagaaagccatcctgcatgtgtactgggaagagttccagaaagaccctgtgggcctgatgagcagagtggcccagcctgccagcaagaagattgaccagaacaaactgaagccagagatggatgagaagggcaacctgaccacagctggctttgcctgctctcagtgtggccagcctctgtttgtgtacaagctggaacaagtgtctgagaaaggcaaggcctacaccaactactttggcagatgcaatgtggctgagcatgagaagctgatcctgctggcccagctgaagcctgaaaaggactctgatgaggctgtgacctacagcctgggcaagtttggacagagagccctggacttctacagcatccatgtgaccaaagaaagcacacaccctgtgaagcccctggctcagattgctggcaacagatatgcctctggacctgtgggcaaagccctgtctgatgcctgcatgggaaccattgccagctttctgagcaagtaccaggacatcatcattgagcaccagaaagtggtcaaggggaaccagaagaggctggaatctctgagagagctggctggcaaagagaacctggaatacccctctgtgaccctgcctcctcagcctcacaccaaagagggtgttgatgcctacaatgaagtgattgccagagtcaggatgtgggtcaacctgaatctgtggcagaagctgaagctgagcagggatgatgccaagcctctgctgagactgaagggcttccctagcttcccactggtggaaaggcaggctaatgaagtggattggtgggacatggtctgcaatgtgaagaaactgatcaatgagaagaaagaggatggcaaggttttctggcagaacctggctggctacaagaggcaagaagccctgaggccttacctgtcctctgaggaagataggaagaaggggaagaagtttgccagataccagctgggagatctgctgctgcacctggaaaagaaacatggggaagattggggcaaagtgtatgatgaggcctgggagagaattgacaagaaggtggaaggcctgagcaagcacattaagctggaagaggaaagaagatctgaggatgcccagagcaaggctgccctgactgattggctgagagccaaggccagctttgtgattgagggcctgaaagaggctgacaaggatgagttctgtagatgtgaactgaagctgcaaaagtggtatggggacctgaggggcaagccctttgccattgaggcagagaacagcatcctggacatcagtggcttcagcaagcagtacaactgtgccttcatttggcagaaggatggggttaagaagctcaacctgtacctgatcatcaactacttcaaaggtggcaagctgaggttcaagaagatcaagccagaggcctttgaggccaacaggttctacacagtgatcaacaaaaagtctggggagattgtgcccatggaagtgaacttcaactttgatgatcccaacctcatcatcctgccactggcctttggcaagagacagggcagagaattcatctggaatgacctgctgagcctggaaacaggcagcctgaaactggccaatggcagagtgattgagaaaaccctgtacaacagaaggaccagacaggatgagcctgcactgtttgtggccctgacctttgagagaagggaagtgctggatagcagcaacatcaagcccatgaacctgattggagtggacagaggggagaatatccctgctgtcattgccctgacagaccctgagggctgtcccctgagcagattcaaggactccctgggcaaccccacacacattctgagaattggggagagctacaaagagaagcagagaaccatccaggccaagaaagaagtggaacagaggagagctggaggctactctaggaagtatgccagcaaagccaagaatctggctgatgacatggtcagaaacacagccagggacctgctgtactatgctgtgacccaggatgccatgctgatctttgagaatctgagcagaggatttgggagacaaggcaagaggaccttcatggctgaaagacagtacaccaggatggaagattggctgactgccaaactggcctatgagggactgagcaagacctacctgtccaagacactggcccagtatacctccaagacctgcagcaattgtggcttcaccatcacctctgcagactatgacagagtgctggaaaagctcaagaaaacagccacaggctggatgaccaccatcaatgggaaagagctgaaggttgagggccagatcacctactacaacagatacaaaaggcagaatgtggttaaggacctgtctgtggaactggacagactgtctgaggaatctgtgaacaatgacatcagcagctggaccaagggcagatctggggaagctctgagcctgctgaagaagagattcagccacagacctgtgcaagagaagtttgtgtgtctgaactgtggctttgagacacatgctgatgaacaggctgctctgaacattgccagaagctggctgttcctgagaagccaagagtacaagaagtaccagaccaacaagaccacaggcaacactgacaagagggcctttgtggaaacctggcagagcttctacagaaagaaactcaaagaagtctggaagcctgctgtgggcagccctgcagctaaaagggtcaagctggactga

SEQ ID NO: 3236 - DNA, 208 bp, synthetic construct
  source 1..208: mol_type = other DNA
ctgtgccttctagttgccagccatctgttgtttgcccctccccagtgccttccttgaccctggaaggtgccactcccactgtcctttcctaataaaatgaggaaattgcatcacattgtctgagtaggtgtcattctattctggggggtggggtggggcaggacagcaagggggaggattgggaagagaatagcaggcatgctgggga

SEQ ID NO: 3237 - DNA, 241 bp, synthetic construct
  source 1..241: mol_type = other DNA
gagggcctatttcccatgattccttcatatttgcatatacaatacaaggctgttagagagataattggaattaatttgactgtaaacacaaagatattagtacaaaatatttgatgtagaaagtaataatttcttgggtagtttgcagttttaaaattatgttttaaaatggactatcatatgcttaccataacttgaaagtatttctatttcttggctttatatatcttgtggaaaggac

SEQ ID NO: 3238 - DNA, 141 bp, synthetic construct
  source 1..141: mol_type = other DNA
aggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 3239 - protein, 72 aa, synthetic construct
MDAKSLTAWSRTLVTFKDVFVDFTREEWKLLDTAQQIVYRNVMLENYKNLVSLGYQLTKPDVILRLEKGEEP

SEQ ID NO: 3240 - protein, 100 aa, synthetic construct
MNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESL

SEQ ID NO: 3241 - protein, 302 aa, synthetic construct
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 3242 - protein, 1765 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLTSPKKKRKVDYKDDDDKDYKDDDDK

SEQ ID NO: 3243 - protein, 1737 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMDAKSLTAWSRTLVTFKDVFVDFTREEWKLLDTAQQIVYRNVMLENYKNLVSLGYQLTKPDVILRLEKGEEPTSPKKKRKVDYKDDDDKDYKDDDDK

SEQ ID NO: 3244 - protein, 1756 aa, synthetic construct
MAPKKKRKVSRGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLTSPKKKRKVDYKDDDDKDYKDDDDKGGPSSGAPPPSGGSPAGSPTSTEEGTSESATPESGPGTSTEPSEGSAPGSPAGSPTSTEEGTSTEPSEGSAPGTSTEPSEMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 3245 - protein, 1728 aa, synthetic construct
MAPKKKRKVSRGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMDAKSLTAWSRTLVTFKDVFVDFTREEWKLLDTAQQIVYRNVMLENYKNLVSLGYQLTKPDVILRLEKGEEPTSPKKKRKVDYKDDDDKDYKDDDDKGGPSSGAPPPSGGSPAGSPTSTEEGTSESATPESGPGTSTEPSEGSAPGSPAGSPTSTEEGTSTEPSEGSAPGTSTEPSEMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 3246 - protein, 1756 aa, synthetic construct
MAPKKKRKVSRGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGPSSGAPPPSGGSPAGSPTSTEEGTSESATPESGPGTSTEPSEGSAPGSPAGSPTSTEEGTSTEPSEGSAPGTSTEPSEMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSTSMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLTSPKKKRKVDYKDDDDKDYKDDDDK

SEQ ID NO: 3247 - protein, 1728 aa, synthetic construct
MAPKKKRKVSRGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGPSSGAPPPSGGSPAGSPTSTEEGTSESATPESGPGTSTEPSEGSAPGSPAGSPTSTEEGTSTEPSEGSAPGTSTEPSEMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSTSMDAKSLTAWSRTLVTFKDVFVDFTREEWKLLDTAQQIVYRNVMLENYKNLVSLGYQLTKPDVILRLEKGEEPTSPKKKRKVDYKDDDDKDYKDDDDK

SEQ ID NO: 3248 - protein, 1754 aa, synthetic construct
MAPKKKRKVSRMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKVDYKDDDDKDYKDDDDK

SEQ ID NO: 3249 - protein, 1726 aa, synthetic construct
MAPKKKRKVSRMDAKSLTAWSRTLVTFKDVFVDFTREEWKLLDTAQQIVYRNVMLENYKNLVSLGYQLTKPDVILRLEKGEEPGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKVDYKDDDDKDYKDDDDK

SEQ ID NO: 3250 - protein, 1752 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKVDYKDDDDKDYKDDDDK

SEQ ID NO: 3251 - protein, 1724 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMDAKSLTAWSRTLVTFKDVFVDFTREEWKLLDTAQQIVYRNVMLENYKNLVSLGYQLTKPDVILRLEKGEEPGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKVDYKDDDDKDYKDDDDK

SEQ ID NO: 3252 - protein, 161 aa, synthetic construct
TKAADDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPACHDSDESDSGKAVEVQNKQMIEWALGGFQPSGPKGLEPPEEEKNPYKEV

SEQ ID NO: 3253 - protein, 41 aa, synthetic construct
YTDMWVEPEAAAYAPPPPAKKPRKSTTEKPKVKEIIDERTR

SEQ ID NO: 3254 - protein, 2073 aa, synthetic construct
MAPKKKRKVSRMTKAADDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPACHDSDESDSGKAVEVQNKQMIEWALGGFQPSGPKGLEPPEEEKNPYKEVYTDMWVEPEAAAYAPPPPAKKPRKSTTEKPKVKEIIDERTRERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 3255 - protein, 1586 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKVDYKDDDDKDYKDDDDK

SEQ ID NO: 3256 - protein, 1772 aa, synthetic construct
MAPKKKRKVSRMTKAADDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPACHDSDESDSGKAVEVQNKQMIEWALGGFQPSGPKGLEPPEEEKNPYKEVYTDMWVEPEAAAYAPPPPAKKPRKSTTEKPKVKEIIDERTRERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 3257 - protein, 1847 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMDAKSLTAWSRTLVTFKDVFVDFTREEWKLLDTAQQIVYRNVMLENYKNLVSLGYQLTKPDVILRLEKGEEPTSPKKKRKV

SEQ ID NO: 3258 - protein, 1875 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLTSPKKKRKV

SEQ ID NO: 3259 - protein, 1721 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMDAKSLTAWSRTLVTFKDVFVDFTREEWKLLDTAQQIVYRNVMLENYKNLVSLGYQLTKPDVILRLEKGEEPTSPKKKRKV

SEQ ID NO: 3260 - protein, 1845 aa, synthetic construct
MAPKKKRKVSRMDAKSLTAWSRTLVTFKDVFVDFTREEWKLLDTAQQIVYRNVMLENYKNLVSLGYQLTKPDVILRLEKGEEPGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 3261 - protein, 1873 aa, synthetic construct
MAPKKKRKVSRMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 3262 - protein, 1710 aa, synthetic construct
MAPKKKRKVSRMDAKSLTAWSRTLVTFKDVFVDFTREEWKLLDTAQQIVYRNVMLENYKNLVSLGYQLTKPDVILRLEKGEEPGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 3263 - protein, 1717 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMDAKSLTAWSRTLVTFKDVFVDFTREEWKLLDTAQQIVYRNVMLENYKNLVSLGYQLTKPDVILRLEKGEEPGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 3264 - protein, 1738 aa, synthetic construct
MAPKKKRKVSRMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 3265 - protein, 1730 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSSQGSVTFRDVAIDFSQEEWKWLQPAQRDLYRRVMLENYGHLVSLGLSISKPDVVSLLEQGKEPWLGKRNVKRDLFSASESSTSPKKKRKV

SEQ ID NO: 3266 - RNA, 20 nt, synthetic construct
  source 1..20: mol_type = other RNA
actgggaggctcagcccatg

SEQ ID NO: 3267 - RNA, 20 nt, synthetic construct
  source 1..20: mol_type = other RNA
tgttctgtcttgaactagct

SEQ ID NO: 3268 - RNA, 20 nt, synthetic construct
  source 1..20: mol_type = other RNA
tgagtgtcttgtcttgctca

SEQ ID NO: 3269 - protein, 11 aa, synthetic construct
MAPKKKRKVSR

SEQ ID NO: 3270 - protein, 136 aa, synthetic construct
MERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFAN

SEQ ID NO: 3271 - protein, 8 aa, synthetic construct
GGSGGGSA

SEQ ID NO: 3272 - protein, 11 aa, synthetic construct
RSGGSGGGSTS

SEQ ID NO: 3273 - protein, 9 aa, synthetic construct
TSPKKKRKV

SEQ ID NO: 3274 - DNA, 44 bp, synthetic construct; identical to SEQ ID NO: 3047
  source 1..44: mol_type = other DNA

SEQ ID NO: 3275 - DNA, 39 bp, synthetic construct; identical to SEQ ID NO: 3133
  source 1..39: mol_type = other DNA

SEQ ID NO: 3276 - DNA, 2934 bp, synthetic construct
  source 1..2934: mol_type = other DNA
caggagatcaagcggattaataaaattcggagaagactggtgaaggattctaacacaaagaaggctggcaagacaggccctatgaagacactgctggtgagagtgatgacacccgacctgagagaaagactggaaaacctgagaaagaagcctgagaatatcccccagcccatcagcaacacaagccgggccaacctgaataagctgctgaccgactacaccgaaatgaagaaggccatcctgcacgtgtattgggaagagttccagaaagacccagtcggcctgatgagcagagtggctcagcctgccagcaagaagatcgatcagaacaagctgaagcccgaaatggacgagaaggggaacctgacaaccgccggctttgcctgtagccagtgcggccagcccctgtttgtgtacaaactggaacaggtgagcgaaaagggcaaggcttacacgaattacttcggcagatgcaacgtggccgagcacgagaagctgatcctgctggcccagctgaagcctgagaaggatagcgatgaggcagtgacatattccctgggcaagttcggacagcgggccctggatttttattccattcatgtgaccaaggaatccacccaccccgtcaagcctcttgcccaaattgccggcaacagatacgccagcggccccgtgggcaaggccctgagcgacgcctgtatgggcaccatcgccagcttcctgtctaagtaccaggacattatcatcgagcaccagaaggtggtgaagggcaaccagaagagactggagagcctgcgcgagctggccggcaaggaaaacctggagtatcctagcgtgaccctgcctcctcagcctcatacaaaggagggcgtggatgcctacaacgaagtgatcgcccgggtgcggatgtgggtgaacctgaatctgtggcagaagctgaagctgtctagagacgacgccaagcccctgctgagactgaagggcttccccagcttccctctggtggagagacaggcaaatgaagtggactggtgggacatggtgtgtaacgtgaagaagctgatcaatgagaagaaggaggacggcaaagtgttctggcagaatctggccggctacaagcgtcaggaggccctgcggccctacctgagcagcgaggaagacagaaagaagggcaagaagttcgcccggtatcagctgggggacctgctgctgcacctcgagaagaagcacggcgaagactgggggaaggtgtacgatgaggcctgggagcggatcgataagaaggtggagggcctgagcaagcacatcaagctggaggaggaacggagatctgaggacgcccagagcaaggccgccctgaccgactggctgagagccaaggccagcttcgtcatcgaggggctgaaggaggccgacaaggacgagttctgccggtgcgaactgaagctgcagaagtggtacggagatctgagaggcaaacctttcgccatcgaggccgagaacagcatcctggacatcagcggcttcagcaagcagtacaactgcgcctttatttggcagaaggacggagtgaagaagctgaacctgtacctgatcatcaactatttcaagggcggcaagctgagattcaagaagatcaagcctgaagccttcgaggccaacagattctacaccgtgattaacaagaaaagcggagagatcgtgccaatggaagtgaacttcaacttcgacgaccctaacctgatcatcctgcccctggcatttggcaagcggcagggcagagagttcatctggaacgacctgctgtctctggagaccggcagcctgaagctggccaacggcagagtgatcgagaagacactgtacaacagacgaaccagacaagacgagcccgccctgtttgtggccctgaccttcgagagaagagaggtgctggacagcagcaatatcaagcctatgaacctgatcggcgtggaccggggcgagaacatccctgccgtgatcgcccttaccgaccccgagggatgccctctgagccggtttaaagacagcctgggcaaccctacccacatcctgagaattggcgagtcctacaaggagaagcagagaaccatccaggccaagaaggaggtggagcagcggcgggctggcggctactcccggaagtacgccagcaaggccaagaacctggccgacgacatggttagaaataccgccagagacctcctgtactacgctgtgacccaggacgccatgctgatcttcgagaacctgagcagaggcttcggcagacagggcaagagaaccttcatggccgagagacagtacacccggatggaggactggctgaccgccaagctggcctacgagggcctgccctctaagacctacctgtccaagaccttggcacagtacaccagcaagacatgctctaactgcggcttcacaatcacgagcgccgactacgaccgggtgctggagaaactgaagaagaccgccacaggctggatgaccaccattaacggcaaggagctgaaggtggagggccagatcacctactacaacaggtacaaacggcagaacgtggtgaaggacctgagcgtggaactggatagactgagcgaggaaagcgtaaacaatgacatcagcagctggaccaagggccggagcggcgaggccctgagcctgctgaagaagagattctcccacagaccagtgcaggagaagttcgtgtgtctgaactgcggcttcgagacccacgccgacgagcaagccgccctgaacatcgcccggtcttggcttttcctgcggagccaggagtacaagaagtaccagacaaacaagaccacaggcaacacagacaagagagccttcgtcgagacctggcagagcttctacagaaagaagctgaaggaggtgtggaagcctgccgtg

SEQ ID NO: 3277 - DNA, 36 bp, synthetic construct
  source 1..36: mol_type = other DNA
ggaagccccgctgccaagagagtgaagctggactaa

SEQ ID NO: 3278 - DNA, 93 bp, synthetic construct; identical to SEQ ID NO: 3055
  source 1..93: mol_type = other DNA

SEQ ID NO: 3279 - DNA, 79 bp, synthetic construct
  source 1..79: mol_type = other DNA
aaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3280 - RNA, 3230 nt, synthetic construct
  source 1..3230: mol_type = other RNA
  modified_base order(4,22,32,34,46,53,56,67,73,77,91,100,101,104,109,110,121,124,131,132,134,149,164,166,175,178,181,187,190,202,214,223,236,242,244,256,280,284,289,292,300,310,322,325,331,333,335,336,345,346,361,367,370,379,383,389,403,407,418,430,448,462,463,464,468,470,477,490,492,493,494,496,498,505,514,533,534,542,543,546,547,555,562,580,583,586,589,598,605,614,620,628,633,635,636,640,648,649,664,668,669,670,671,672,674,675,679,680,683,685,696,709,716,718,719,727,728,741,757,769,780,782,784,793,801,802,805,807,809,813,823,824,826,829,844,847,868,877,886,904,909,911,914,919,925,929,932,938,941,955,959,963,973,976,985,991,993,997,1003,1007,1009,1011,1021,1027,1029,1031,1051,1054,1060,1068,1069,1077,1078,1082,1084,1087,1103,1108,1113,1116,1123,1126,1128,1130,1135,1144,1147,1151,1174,1176,1177,1179,1187,1189,1197,1205,1216,1224,1228,1263,1264,1272,1274,1279,1288,1291,1294,1300,1323,1333,1335,1340,1347,1357,1361,1369,1378,1390,1396,1413,1415,1441,1449,1453,1470,1471,1474,1477,1486,1509,1510,1512,1518,1525,1531,1539,1542,1550,1552,1565,1566,1567,1573,1591,1594,1600,1608,1609,1620,1626,1632,1633,1634,1636,1637,1638,1654,1663,1669,1671,1675,1678,1681,1686,1688,1689,1690,1705,1710,1711,1720,1727,1734,1735,1749,1750,1752,1759,1762,1763,1783,1786,1792,1798,1803,1804,1809,1810,1820,1825,1828,1831,1834,1840,1845,1846,1847,1869,1870,1873,1875,1885,1888,1890,1892,1894,1909,1915,1930,1933,1945,1947,1981,1983,1984,1985,1987,1993,1998,1999,2014,2017,2030,2032,2039,2041,2047,2050,2056,2074,2078,2083,2086,2092,2093,2109,2114,2116,2124,2125,2126,2137,2147,2155,2158,2164,2165,2172,2175,2197,2215,2231,2238,2241,2250,2272,2284,2287,2288,2294,2308,2311,2313,2316,2321,2323,2338,2341,2344,2346,2347,2356,2367,2368,2391,2392,2395,2409,2419,2427,2431,2443,2448,2458,2463,2465,2472,2476,2478,2487,2488,2496,2511,2514,2516,2520,2526,2527,2533,2547,2557,2560,2569,2589,2593,2602,2603,2617,2623,2635,2640,2643,2652,2668,2671,2680,2686,2692,2696,2701,2716,2723,2728,2736,2764,2770,2773,2784,2785,2787,2800,2811,2812,2815,2817,2819,2821,2826,2832,2833,2863,2869,2877,2879,2880,2884,2885,2886,2887,2890,2904,2913,2955,2956,2959,2967,2976,2977,2979,2992,3001,3003,3011,3016,3029,3040,3046,3051,3056,3060,3061,3063,3071,3072,3076,3077,3079,3085,3090,3091,3093,3094,3096,3098,3102,3103,3109,3111,3115,3117,3118,3121,3123,3124,3125,3129,3136,3140,3147,3149): mod_base = m1f
aaataagagagaaaagaagagtaagaagaaatataagagccaccatggcccctgctgccaagagagtgaagctggatagcagacaggagatcaagcggattaataaaattcggagaagactggtgaaggattctaacacaaagaaggctggcaagacaggccctatgaagacactgctggtgagagtgatgacacccgacctgagagaaagactggaaaacctgagaaagaagcctgagaatatcccccagcccatcagcaacacaagccgggccaacctgaataagctgctgaccgactacaccgaaatgaagaaggccatcctgcacgtgtattgggaagagttccagaaagacccagtcggcctgatgagcagagtggctcagcctgccagcaagaagatcgatcagaacaagctgaagcccgaaatggacgagaaggggaacctgacaaccgccggctttgcctgtagccagtgcggccagcccctgtttgtgtacaaactggaacaggtgagcgaaaagggcaaggcttacacgaattacttcggcagatgcaacgtggccgagcacgagaagctgatcctgctggcccagctgaagcctgagaaggatagcgatgaggcagtgacatattccctgggcaagttcggacagcgggccctggatttttattccattcatgtgaccaaggaatccacccaccccgtcaagcctcttgcccaaattgccggcaacagatacgccagcggccccgtgggcaaggccctgagcgacgcctgtatgggcaccatcgccagcttcctgtctaagtaccaggacattatcatcgagcaccagaaggtggtgaagggcaaccagaagagactggagagcctgcgcgagctggccggcaaggaaaacctggagtatcctagcgtgaccctgcctcctcagcctcatacaaaggagggcgtggatgcctacaacgaagtgatcgcccgggtgcggatgtgggtgaacctgaatctgtggcagaagctgaagctgtctagagacgacgccaagcccctgctgagactgaagggcttccccagcttccctctggtggagagacaggcaaatgaagtggactggtgggacatggtgtgtaacgtgaagaagctgatcaatgagaagaaggaggacggcaaagtgttctggcagaatctggccggctacaagcgtcaggaggccctgcggccctacctgagcagcgaggaagacagaaagaagggcaagaagttcgcccggtatcagctgggggacctgctgctgcacctcgagaagaagcacggcgaagactgggggaaggtgtacgatgaggcctgggagcggatcgataagaaggtggagggcctgagcaagcacatcaagctggaggaggaacggagatctgaggacgcccagagcaaggccgccctgaccgactggctgagagccaaggccagcttcgtcatcgaggggctgaaggaggccgacaaggacgagttctgccggtgcgaactgaagctgcagaagtggtacggagatctgagaggcaaacctttcgccatcgaggccgagaacagcatcctggacatcagcggcttcagcaagcagtacaactgcgcctttatttggcagaaggacggagtgaagaagctgaacctgtacctgatcatcaactatttcaagggcggcaagctgagattcaagaagatcaagcctgaagccttcgaggccaacagattctacaccgtgattaacaagaaaagcggagagatcgtgccaatggaagtgaacttcaacttcgacgaccctaacctgatcatcctgcccctggcatttggcaagcggcagggcagagagttcatctggaacgacctgctgtctctggagaccggcagcctgaagctggccaacggcagagtgatcgagaagacactgtacaacagacgaaccagacaagacgagcccgccctgtttgtggccctgaccttcgagagaagagaggtgctggacagcagcaatatcaagcctatgaacctgatcggcgtggaccggggcgagaacatccctgccgtgatcgcccttaccgaccccgagggatgccctctgagccggtttaaagacagcctgggcaaccctacccacatcctgagaattggcgagtcctacaaggagaagcagagaaccatccaggccaagaaggaggtggagcagcggcgggctggcggctactcccggaagtacgccagcaaggccaagaacctggccgacgacatggttagaaataccgccagagacctcctgtactacgctgtgacccaggacgccatgctgatcttcgagaacctgagcagaggcttcggcagacagggcaagagaaccttcatggccgagagacagtacacccggatggaggactggctgaccgccaagctggcctacgagggcctgccctctaagacctacctgtccaagaccttggcacagtacaccagcaagacatgctctaactgcggcttcacaatcacgagcgccgactacgaccgggtgctggagaaactgaagaagaccgccacaggctggatgaccaccattaacggcaaggagctgaaggtggagggccagatcacctactacaacaggtacaaacggcagaacgtggtgaaggacctgagcgtggaactggatagactgagcgaggaaagcgtaaacaatgacatcagcagctggaccaagggccggagcggcgaggccctgagcctgctgaagaagagattctcccacagaccagtgcaggagaagttcgtgtgtctgaactgcggcttcgagacccacgccgacgagcaagccgccctgaacatcgcccggtcttggcttttcctgcggagccaggagtacaagaagtaccagacaaacaagaccacaggcaacacagacaagagagccttcgtcgagacctggcagagcttctacagaaagaagctgaaggaggtgtggaagcctgccgtgggaagccccgctgccaagagagtgaagctggactaagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3281 - protein, 978 aa, synthetic construct
QEGKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3282 - protein, 978 aa, synthetic construct
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3283 - protein, 978 aa, synthetic construct
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3284 - protein, 978 aa, synthetic construct
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3285 - protein, 978 aa, synthetic construct
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3286 - protein, 978 aa, synthetic construct
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3287 - protein, 978 aa, synthetic construct
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3288 - protein, 978 aa, synthetic construct
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3289 - protein, 978 aa, synthetic construct
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3290 - protein, 978 aa, synthetic construct
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3291 - protein, 978 aa, synthetic construct
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3292 - protein, 978 aa, synthetic construct
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3293 - protein, 979 aa, synthetic construct
QEIGKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3294 - protein, 979 aa, synthetic construct
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3295 - protein, 979 aa, synthetic construct
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3296 - protein, 979 aa, synthetic construct
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3297 - protein, 979 aa, synthetic construct
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3298 - protein, 979 aa, synthetic construct
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3299 - protein, 979 aa, synthetic construct
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3300 - protein, 979 aa, synthetic construct
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3301 - protein, 979 aa, synthetic construct
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3302 - protein, 979 aa, synthetic construct
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3303 - protein, 979 aa, synthetic construct
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3304 - protein, 979 aa, synthetic construct
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3305 - protein, 978 aa, synthetic construct
QEIKRINGIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3306 - protein, 978 aa, synthetic construct
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3307 - protein, 978 aa, synthetic construct
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3308 - protein, 978 aa, synthetic construct
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3309 - protein, 978 aa, synthetic construct
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3310 - protein, 978 aa, synthetic construct
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3311 - protein, 978 aa, synthetic construct
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3312 - protein, 978 aa, synthetic construct
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3313 - protein, 978 aa, synthetic construct
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3314 - protein, 978 aa, synthetic construct
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3315 - protein, 978 aa, synthetic construct
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3316 - protein, 978 aa, synthetic construct
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3317 - protein, 979 aa, synthetic construct
QEIKRINKIRRRLVKDSNTKKAGKTRGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3318 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3319 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3320 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3321 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3322 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3323 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3324 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3325 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3326 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3327 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3328 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3329 - protein, 978 aa, synthetic construct
QEIKRINKIRRRLVKDSNTKKAGKTGPMKTLLVPVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3330 - protein, 978 aa, synthetic construct
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3331 - protein, 978 aa, synthetic construct
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3332 - protein, 978 aa, synthetic construct
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3333 - protein, 978 aa, synthetic construct
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3334 - protein, 978 aa, synthetic construct
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3335 - protein, 978 aa, synthetic construct
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3336 - protein, 978 aa, synthetic construct
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3337 - protein, 978 aa, synthetic construct
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3338 - protein, 978 aa, synthetic construct
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3339 - protein, 978 aa, synthetic construct
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3340 - protein, 978 aa, synthetic construct
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3341 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3342 - protein, 978 aa, synthetic construct
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3343 - protein, 978 aa, synthetic construct
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3344 - protein, 978 aa, synthetic construct
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3345 - protein, 978 aa, synthetic construct
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3346 - protein, 978 aa, synthetic construct
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3347 - protein, 978 aa, synthetic construct
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3348 - protein, 978 aa, synthetic construct
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3349 - protein, 978 aa, synthetic construct
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3350 - protein, 978 aa, synthetic construct
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3351 - protein, 978 aa, synthetic construct
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3352 - protein, 978 aa, synthetic construct
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3353 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3354 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3355 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3356 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3357 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3358 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3359 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3360 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3361 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3362 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3363 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3364 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3365 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3366 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3367 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3368 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3369 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3370 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3371 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3372 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3373 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3374 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3375 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3376 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3377 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3378 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3379 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3380 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3381 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3382 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3383 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3384 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3385 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3386 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3387 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3388 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3389 - protein, 978 aa, synthetic construct
QEGKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3390 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3391 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3392 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3393 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3394 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3395 - protein, 979 aa, synthetic construct
QEIGKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3396 - protein, 979 aa, synthetic construct
QEGKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3397 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3398 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3399 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3400 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3401 - protein, 978 aa, synthetic construct
QEIKRINGIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3402 - protein, 982 aa, synthetic construct
QEIGKRINKIRRRLVKDSNTKKAGKTRKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3403 - protein, 978 aa, synthetic construct
QEGKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3404 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3405 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3406 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3407 - protein, 979 aa, synthetic construct
QEIKRINKIRRRLVKDSNTKKAGKTRGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3408 - protein, 979 aa, synthetic construct
QEIKRINGIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3409 - protein, 979 aa, synthetic construct
QEIGKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3410 - protein, 979 aa, synthetic construct
QEGGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3411 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3412 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3413 - protein, 979 aa, synthetic construct
QEIGRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3414 - protein, 978 aa, synthetic construct
QEIGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3415 - protein, 978 aa, synthetic construct
QEIGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3416 - protein, 978 aa, synthetic construct
QEIGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3417 - protein, 978 aa, synthetic construct
QEIGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3418 - protein, 978 aa, synthetic construct
QEIGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3419 - protein, 982 aa, synthetic construct
QEIKGRINKIRRRLVKDSNTKKAGKTRKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3420 - protein, 979 aa, synthetic construct
QEIKGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3421 - protein, 979 aa, synthetic construct
QEIKGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3422 - protein, 979 aa, synthetic construct
QEIKGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3423 - protein, 979 aa, synthetic construct
QEIKGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3424 - protein, 979 aa, synthetic construct
QEIKGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3425 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRWWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3426 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRWWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3427 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRWWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3428 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRWWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3429 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRWWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3430 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCDLKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3431 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCDLKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3432 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCDLKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3433 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCDLKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3434 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCDLKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3435 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCDLKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3436 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGERYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3437 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGERYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3438 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGERYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3439 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGERYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3440 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGERYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3441 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGERYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3442 - RNA, 22 nt, synthetic construct
  source 1..22: mol_type = other RNA
agctccctcttcggagggagca

SEQ ID NO: 3443 - RNA, 109 nt, synthetic construct
  source 1..109: mol_type = other RNA
  modified_base 1..4: mod_base = OTHER; note = linked via phosphorothioate
  modified_base 106..109: mod_base = OTHER; note = linked via phosphorothioate
  modified_base 1: mod_base = OTHER; note = 2'-O-methyladenosine
  modified_base 2: mod_base = cm
  modified_base 3: mod_base = um
  modified_base 107: mod_base = cm
  modified_base 108: mod_base = gm
  modified_base 109: mod_base = OTHER; note = 2'-O-methyladenosine
actggcgcttctatctgattactctgagcgccatcaccagcgactatgtcgtagtgggtaaagctccctcttcggagggagcatcagaggaggaggacggcctggccga

SEQ ID NO: 3444 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3445 - protein, 978 aa, synthetic construct
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3446 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKKFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3447 - skipped

SEQ ID NO: 3448 - DNA, 90 bp, synthetic construct
  source 1..90: mol_type = other DNA
actggcgcttctatctgattactctgagccgccatcaccagcgactatgtcgtagtgggtaaagctccctcttcggagggagcatcagag

SEQ ID NO: 3449 - DNA, 99 bp, synthetic construct
  source 1..99: mol_type = other DNA
actgggccttctatctgattactctgaggcccatcaccagcgactatgtcgtagtgggtaaagccgcttacggacttcggtccgtaagaggcatcagag

SEQ ID NO: 3450 - DNA, 89 bp, synthetic construct
  source 1..89: mol_type = other DNA
actggcgcttttatctgattactttgagagccatcaccagcgactatgtcgtagtgggtaaagctccctcttcggagggagcatcaaag

SEQ ID NO: 3451 - RNA, 90 nt, synthetic construct
  source 1..90: mol_type = other RNA
actggcgcttctatctgattactctgagccgccatcaccagcgactatgtcgtagtgggtaaagctccctcttcggagggagcatcagag

SEQ ID NO: 3452 - RNA, 99 nt, synthetic construct
  source 1..99: mol_type = other RNA
actgggccttctatctgattactctgaggcccatcaccagcgactatgtcgtagtgggtaaagccgcttacggacttcggtccgtaagaggcatcagag

SEQ ID NO: 3453 - DNA, 23 bp, synthetic construct
  source 1..23: mol_type = other DNA
gcggcctctagactcgaggcgtt

SEQ ID NO: 3454 - DNA, 252 bp, synthetic construct
  source 1..252: mol_type = other DNA
aatggaggcggtactatgtagatgagaattcaggagcaaactgggaaaagcaactgcttccaaatatttgtgatttttacagtgtagttttggaaaaactcttagcctaccaattcttctaagtgttttaaaatgtgggagccagtacacatgaagttatagagtgttttaatgaggcttaaatatttaccgtaactatgaaatgctacgcatatcatgctgttcaggctccgtggccacgcaactcatact

SEQ ID NO: 3455 - DNA, 18 bp, synthetic construct
  source 1..18: mol_type = other DNA
ctctggctaactaccggt

SEQ ID NO: 3456 - DNA, 33 bp, synthetic construct
  source 1..33: mol_type = other DNA
atggccccagcggccaaacgggtgaagctggac

SEQ ID NO: 3457 - DNA, 2934 bp, synthetic construct
  source 1..2934: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 3458 - DNA, 27 bp, synthetic construct
  source 1..27: mol_type = other DNA
ccagccgcgaagcgagtgaaactggac

SEQ ID NO: 3459 - DNA, 30 bp, synthetic construct
  source 1..30: mol_type = other DNA
gaattcctagagctcgctgatcagcctcga

SEQ ID NO: 3460 - DNA, 208 bp, synthetic construct
  source 1..208: mol_type = other DNA
ctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagagaatagcaggcatgctgggga

SEQ ID NO: 3461 - DNA, 241 bp, synthetic construct
  source 1..241: mol_type = other DNA
gagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggac

SEQ ID NO: 3462 - DNA, 20 bp, synthetic construct
  source 1..20: mol_type = other DNA
caagaggagaagcagtttgg

SEQ ID NO: 3463 - DNA, 17 bp, synthetic construct
  source 1..17: mol_type = other DNA
ttttttttggcggccgc

SEQ ID NO: 3464 - DNA, 20 bp, synthetic construct
  source 1..20: mol_type = other DNA
tggtgaagatgagtggcgac

SEQ ID NO: 3465 - DNA, 20 bp, synthetic construct
  source 1..20: mol_type = other DNA
aggtcatcacagttggggcc

SEQ ID NO: 3466 - RNA, 20 nt, synthetic construct
  source 1..20: mol_type = other RNA
tggtgaagatgagtggcgac

SEQ ID NO: 3467 - RNA, 20 nt, synthetic construct
  source 1..20: mol_type = other RNA
aggtcatcacagttggggcc

What is claimed is:

1. A system comprising a repressor fusion protein and a guide ribonucleic acid (gRNA), wherein the repressor fusion protein comprises:

(a) a catalytically-dead CasX protein (dCasX);
(b) a repressor domain (RD1) comprising the sequence of SEQ ID NO: 130, 131, 135, or 143, or a sequence having at least 95% identity to the sequence of SEQ ID NO: 130, 131, 135, or 143;
(c) a DNMT3A catalytic domain (DNMT3A); and
(d) a DNMT3L domain (DNMT3L), wherein the gRNA comprises a targeting sequence complementary to a proprotein convertase subtilisin/kexin Type 9 (PCSK9) gene target nucleic acid sequence, wherein the targeting sequence comprises the sequence of SEQ ID NO: 1844, 1852, 1853, 1855, 1858, 1859, 1867, 1869, or 1870, wherein the repressor fusion protein is capable of forming a ribonucleoprotein (RNP) with the gRNA; and wherein the RNP is capable of repressing transcription of the PCSK9 gene upon binding to the PCSK9 gene target nucleic acid sequence.

2. The system of claim 1, wherein the RD1 comprises the sequence of SEQ ID NO: 130, 131, 135 or 143.

3. The system of claim 1, wherein the repressor fusion protein comprises, from N- to C-terminus:

(a) the DNMT3A;
(b) the DNMT3L;
(c) the dCasX; and
(d) the RD1; or wherein the repressor fusion protein comprises, from N- to C-terminus:

(a) the DNMT3A:
(b) the DNMT3L:
(c) the RD1; and
(d) the dCasX.

4. The system of claim 1, wherein the dCasX comprises a sequence selected from the group consisting of SEQ ID NOS: 4-29, or a sequence having at least 90%, at least 91%, at least 92%, at least 93%, at least 94%, at least 95%, at least 96%, at least 97%, at least 98%, or at least 99% sequence identity to the sequence of any one of SEQ ID NOS: 4-29.

5. The system of claim 1, wherein the DNMT3A comprises the sequence of SEQ ID NO: 126, or a sequence having at least 70%, at least 80%, at least 85%, at least 90%, at least 95%, at least 96%, at least 97%, at least 98%, or at least 99% sequence identity to the sequence of SEQ ID NO: 126.

6. The system of claim 1, wherein the DNMT3L comprises the sequence of SEQ ID NO: 127, or a sequence having at least 70%, at least 80%, at least 85%, at least 90%, at least 95%, at least 96%, at least 97%, at least 98%, or at least 99% sequence identity to the sequence of SEQ ID NO: 127.

7. The system of claim 1, wherein the repressor fusion protein comprises one or more linker peptides, and/or one or more nuclear localization signals (NLS).

8. The system of claim 7, wherein the repressor fusion protein comprises, from N- to C-terminus:

(a) NLS-Linker-DNMT3A-Linker-DNMT3L-Linker-Linker-dCasX-Linker-RD1-NLS:

(b) NLS-Linker-dCasX-Linker-RD1-NLS-Linker-DNMT3A-Linker-DNMT3L;
(c) NLS-Linker-dCasX-Linker-DNMT3A-Linker-DNMT3L-Linker-RD1-NLS:
(d) NLS-RD1-Linker-DNMT3A-Linker-DNMT3L-Linker-dCasX-Linker-NLS: or
(e) NLS-DNMT3A-Linker-DNMT3L-Linker-RD1-Linker-dCasX-Linker-NLS.

9. The system of claim 1, wherein the repressor fusion protein comprises, from N- to C-terminus:
(a) NLS-DNMT3A-DNMT3L-dCasX-RD1-NLS;
(b) NLS-dCasX-RD1-NLS-DNMT3A-DNMT3L;
(c) NLS-dCasX-DNMT3A-DNMT3L-RD1-NLS;
(d) NLS-RD1-DNMT3A-DNMT3L-dCasX-NLS; or
(e) NLS-DNMT3A-DNMT3L-RD1-dCasX-NLS.

10. The system of claim 1, wherein the gRNA is a single-molecule gRNA (sgRNA) and comprises a scaffold stem loop comprising the sequence of CCAGCGACUAUGUCGUAGUGG (SEQ ID NO: 1822), or a sequence with 1, 2, 3, 4 or 5 mismatches thereto.

11. The system of claim 1, wherein the gRNA comprises a scaffold comprising a sequence selected from the group consisting of SEQ ID NOS: 1744-1749 and 1751-1821.

12. The system of claim 11, wherein the scaffold comprises the sequence of SEQ ID NO: 1746.

13. The system of claim 1, wherein the gRNA is chemically modified.

14. A composition comprising a first nucleic acid and a second nucleic acid, wherein
(a) the first nucleic acid comprises a guide ribonucleic acid (gRNA) comprising a targeting sequence complementary to a proprotein convertase subtilisin/kexin Type 9 (PCSK9) gene target nucleic acid sequence, wherein the targeting sequence comprises the sequence of SEQ ID NO: 1844, 1852, 1853, 1855, 1858, 1859, 1867, 1869, or 1870, and wherein the gRNA is capable of forming a ribonucleoprotein (RNP) with a repressor fusion protein; and
(b) the second nucleic acid encodes a repressor fusion protein comprising:
i) a catalytically-dead CasX protein (dCasX);
ii) a repressor domain (RD1) comprising the sequence of SEQ ID NO: 130, 131, 135, or 143, or a sequence having at least 95% identity to the sequence of SEQ ID NO: 130, 131, 135, or 143;
iii) a DNMT3A catalytic domain (DNMT3A); and
iv) a DNMT3L domain (DNMT3L).

15. The composition of claim 14, wherein the RD1 comprises the sequence of SEQ ID NO: 130, 131, 135, or 143.

16. A lipid nanoparticle (LNP) comprising the composition of claim 14.

17. A method of repressing transcription of a PCSK9 gene in a population of cells, the method comprising introducing into the cells the composition of claim 14, wherein transcription of the PCSK9 gene is repressed by the repressor fusion protein.

18. A method of treating a PCSK9-related disease or disorder in a subject in need thereof, comprising administering to the subject a therapeutically effective dose of a composition comprising a first nucleic acid and a second nucleic acid, wherein:
(a) the first nucleic acid comprises a guide ribonucleic acid (gRNA) comprising a targeting sequence complementary to a proprotein convertase subtilisin/kexin Type 9 (PCSK9) gene target nucleic acid sequence, wherein the targeting sequence comprises the sequence of SEQ ID NO: 1844, 1852, 1853, 1855, 1858, 1859, 1867, 1869, or 1870, and wherein the gRNA is capable of forming a ribonucleoprotein (RNP) with a repressor fusion protein; and
(b) the second nucleic acid comprises an mRNA encoding a repressor fusion protein comprising:
i) a catalytically-dead CasX protein (dCasX):
ii) a repressor domain (RD1) comprising the sequence of SEQ ID NO: 130, 131, 135, or 143, or a sequence having at least 95% identity to the sequence of SEQ ID NO: 130, 131, 135, or 143;
iii) a DNMT3A catalytic domain (DNMT3A); and
iv) a DNMT3L domain (DNMT3L).

19. The method of claim 18, wherein the RD1 comprises the sequence of SEQ ID NO: 130, 131, 135 or 143.

20. The method of claim 18, wherein the composition is encapsulated in a lipid nanoparticle (LNP).

21. The method of claim 20, wherein the LNP comprises one or more components selected from the group consisting of an ionizable lipid, a helper phospholipid, a polyethylene glycol (PEG)-modified lipid, and cholesterol.

22. The method of claim 18, wherein the PCSK9-related disease is autosomal dominant hypercholesterolemia (ADH), hypercholesterolemia, elevated total cholesterol levels, hyperlipidemia, elevated low-density lipoprotein (LDL) levels, elevated LDL-cholesterol levels, reduced high-density lipoprotein levels, liver steatosis, coronary heart disease, ischemia, stroke, peripheral vascular disease, thrombosis, type 2 diabetes, high elevated blood pressure, atherosclerosis, obesity, aortic stenosis, elevated PCSK9 levels, or a combination thereof.

* * * * *